US007439050B2

(12) United States Patent
Pompejus et al.

(10) Patent No.: US 7,439,050 B2
(45) Date of Patent: Oct. 21, 2008

(54) CORYNEBACTERIUM GLUTAMICUM GENES ENCODING DIAMINOPIMELATE EPIMERASE

(75) Inventors: Markus Pompejus, Freinsheim (DE); Burkhard Kröger, Limburgerhof (DE); Hartwig Schröder, Nußloch (DE); Oskar Zelder, Speyer (DE); Gregor Haberhauer, Limburgerhof (DE)

(73) Assignee: Basf Aktiengesellschaft (DE)

( * ) Notice: Subject to any disclaimer, the term of this patent is extended or adjusted under 35 U.S.C. 154(b) by 0 days.

(21) Appl. No.: 11/055,822

(22) Filed: Feb. 11, 2005

(65) Prior Publication Data

US 2005/0260707 A1 Nov. 24, 2005

Related U.S. Application Data

(63) Continuation of application No. 09/606,740, filed on Jun. 23, 2000, now abandoned.

(60) Provisional application No. 60/141,031, filed on Jun. 25, 1999, provisional application No. 60/142,101, filed on Jul. 2, 1999, provisional application No. 60/148,613, filed on Aug. 12, 1999, provisional application No. 60/187,970, filed on Mar. 9, 2000.

(30) Foreign Application Priority Data

| Jul. 1, 1999 | (DE) | 199 30 476 |
|---|---|---|
| Jul. 8, 1999 | (DE) | 199 31 415 |
| Jul. 8, 1999 | (DE) | 199 31 418 |
| Jul. 8, 1999 | (DE) | 199 31 419 |
| Jul. 8, 1999 | (DE) | 199 31 420 |
| Jul. 8, 1999 | (DE) | 199 31 424 |
| Jul. 8, 1999 | (DE) | 199 31 428 |
| Jul. 8, 1999 | (DE) | 199 31 434 |
| Jul. 8, 1999 | (DE) | 199 31 435 |
| Jul. 8, 1999 | (DE) | 199 31 443 |
| Jul. 8, 1999 | (DE) | 199 31 453 |
| Jul. 8, 1999 | (DE) | 199 31 457 |
| Jul. 8, 1999 | (DE) | 199 31 465 |
| Jul. 8, 1999 | (DE) | 199 31 478 |
| Jul. 8, 1999 | (DE) | 199 31 510 |
| Jul. 8, 1999 | (DE) | 199 31 541 |
| Jul. 8, 1999 | (DE) | 199 31 573 |
| Jul. 8, 1999 | (DE) | 199 31 592 |
| Jul. 8, 1999 | (DE) | 199 31 632 |
| Jul. 8, 1999 | (DE) | 199 31 634 |
| Jul. 8, 1999 | (DE) | 199 31 636 |
| Jul. 8, 1999 | (DE) | 199 32 130 |
| Jul. 9, 1999 | (DE) | 199 32 125 |
| Jul. 9, 1999 | (DE) | 199 32 126 |
| Jul. 9, 1999 | (DE) | 199 32 186 |
| Jul. 9, 1999 | (DE) | 199 32 206 |
| Jul. 9, 1999 | (DE) | 199 32 227 |
| Jul. 9, 1999 | (DE) | 199 32 228 |
| Jul. 9, 1999 | (DE) | 199 32 229 |
| Jul. 9, 1999 | (DE) | 199 32 230 |
| Jul. 14, 1999 | (DE) | 199 32 922 |
| Jul. 14, 1999 | (DE) | 199 32 926 |
| Jul. 14, 1999 | (DE) | 199 32 928 |
| Jul. 14, 1999 | (DE) | 199 33 004 |
| Jul. 14, 1999 | (DE) | 199 33 005 |
| Jul. 14, 1999 | (DE) | 199 33 006 |
| Aug. 27, 1999 | (DE) | 199 40 764 |
| Aug. 27, 1999 | (DE) | 199 40 765 |
| Aug. 27, 1999 | (DE) | 199 40 766 |
| Aug. 27, 1999 | (DE) | 199 40 832 |
| Aug. 31, 1999 | (DE) | 199 41 378 |
| Aug. 31, 1999 | (DE) | 199 41 379 |
| Aug. 31, 1999 | (DE) | 199 41 380 |
| Aug. 31, 1999 | (DE) | 199 41 394 |
| Aug. 31, 1999 | (DE) | 199 41 396 |
| Sep. 3, 1999 | (DE) | 199 42 076 |
| Sep. 3, 1999 | (DE) | 199 42 077 |
| Sep. 3, 1999 | (DE) | 199 42 079 |
| Sep. 3, 1999 | (DE) | 199 42 086 |
| Sep. 3, 1999 | (DE) | 199 42 087 |
| Sep. 3, 1999 | (DE) | 199 42 088 |
| Sep. 3, 1999 | (DE) | 199 42 095 |
| Sep. 3, 1999 | (DE) | 199 42 124 |
| Sep. 3, 1999 | (DE) | 199 42 129 |

(51) Int. Cl.
  C12Q 1/68 (2006.01)
  C12N 9/90 (2006.01)
  C12N 1/20 (2006.01)
  C07H 21/04 (2006.01)

(52) U.S. Cl. .................. 435/233; 435/6; 435/106; 435/183; 435/233; 435/252.3; 435/252.32; 435/320.1; 536/23.2

(58) Field of Classification Search ................ 435/183, 435/233, 252.3, 252.32, 320.1; 536/23.2
  See application file for complete search history.

(56) References Cited

FOREIGN PATENT DOCUMENTS

EP 0204326 A2 12/1986

(Continued)

OTHER PUBLICATIONS

Cole et al. Nature. Jun. 11, 1998; 393(6685):537-44.*

(Continued)

*Primary Examiner*—Tekchand Saidha
*Assistant Examiner*—Christian L Fronda
(74) *Attorney, Agent, or Firm*—Lahive & Cockfield LLP; Maria Laccotripe Zacharakis

(57) ABSTRACT

Isolated nucleic acid molecules, designated MP nucleic acid molecules, which encode novel MP proteins from *Corynebacterium glutamicum* are described. The invention also provides antisense nucleic acid molecules, recombinant expression vectors containing MP nucleic acid molecules, and host cells into which the expression vectors have been introduced. The invention still further provides isolated MP proteins, mutated MP proteins, fusion proteins, antigenic peptides and methods for the improvement of production of a desired compound from *C. glutamicum* based on genetic engineering of MP genes in this organism.

24 Claims, No Drawings

FOREIGN PATENT DOCUMENTS

| | | |
|---|---|---|
| EP | 0358940 A1 | 3/1990 |
| EP | 0 435 132 A1 | 3/1991 |
| JP | 62232392 | 10/1987 |
| JP | 62244382 | 10/1987 |
| JP | 04278088 | 10/1992 |
| JP | 04330284 | 11/1992 |
| JP | 05030977 | 2/1993 |
| JP | 05056782 | 3/1993 |
| JP | 05076352 | 3/1993 |
| JP | 05184366 | 7/1993 |
| JP | 05184371 | 7/1993 |
| JP | 05284970 | 11/1993 |
| JP | 05284972 | 11/1993 |
| JP | 05344881 | 12/1993 |
| JP | 05344893 | 12/1993 |
| JP | 06062866 | 3/1994 |
| JP | 06169780 | 6/1994 |
| JP | 06261766 | 9/1994 |
| JP | 06277067 | 10/1994 |
| JP | 06277073 | 10/1994 |
| JP | 07031476 | 2/1995 |
| JP | 07031478 | 2/1995 |
| JP | 07075578 | 3/1995 |
| JP | 07075579 | 3/1995 |
| JP | 09028391 | 2/1997 |
| JP | 09070291 | 3/1997 |
| JP | 09224661 | 9/1997 |
| WO | WO-9519442 A1 | 7/1995 |
| WO | WO 01/00843 A2 | 1/2001 |

OTHER PUBLICATIONS

Cole et al. Accession AL 123456. Nov. 21, 2003.*
Reiger et al. Glossary of Genetics (1991), p. 16.*
Attwood, et al. Which craft is best in bioformatics? Comput. Chem. 2001, 25(4):329-339.
Bathe, et al. A physical and genetic map of the Corynebacterium glutamicum ATCC 13032 chromosome. Mol Gen Genet. 1996 Sep. 13;252(3):255-65.
Cole, et al. Deciphering the biology of Mycobacterium tuberculosis from the complete genome sequence. Nature. Jun. 11, 1998;393(6685):537-44.
Cole, et al. Accession No. Z98209 AL123456.
Cremer, et al. Control of the lysine biosynthesis sequence in Corybacterium glutamicum as analyzed by overexpression of the individual corresponding genes. Applied and Environmental Microbiology. 1991. 57(6):1746-1752.
Eikmanns, et al. Molecular aspects of lysine, threonine, and isoleucine biosynthesis in Corynebacterium glutamicum. Antonie Van Leewenhoek. 1993;64(2):145-63.
EMBL Accession No. 033231 for Diaminoplmelate epimerase (EC 5.1.1.7) (DAP Epimerase) 1p.
EMBL Accession No. AL021841 for Mycobacterium tuberculosis H37Rv complete genome; segment Nov. 11/13.
GenBank Accession No. AD000002 for Mycobacterium tuberculosis sequence from clone y154. 12pp.
GenBank Accession No. U00019 for Mycobacterium laprae cosmid B2235, Mar. 1, 1994.
GenBank Accession No. Z98209 AL123456 for Mycobacterium tuberculosis H37Rv complete genome; segment 121/162.
International Search Report, mailed Jan. 25, 2001 for PCT/IB00/00923.
International Search Report, mailed Nov. 12, 2001 for PCT/IB00/02035.
Keilhauer, et al. Isoleucine synthesis in Corynebacterium glutamicum: molecular analysis of the IlvB-ilvN-ilvC operon. J. Bacteriol. Sep. 1993;175(17):5595-603.
Park, et al. Isolation and analysis of metA, a methionine biosynthetic gene encoding homoserine acetyltransferase in Corynebacterium glutamicum. Molecules and Cells. 1996, 8(3):286-294.
Peters-Wendisch, et al. Pyruvate carboxylase as an anaplerotic enzyme in Corynebacterium glutamicum. Microbiology. 1997, 143:1095-1103.
Ponting, C.P. Issues in predicting protein function from sequence. Brief Bioinform. Mar. 2001;2(1):19-29.
Ankri, Serge, et al., "Mutations in the Corynebacterium glutamicum Proline Biosynthetic Pathway: a Bypass of the proA Step," Journal of Bacteriology, vol. 178(15):4412-4419 (1996).
Billman-Jacobe, H., "Nucleotide sequence of a recA gene from Corynebacterium glutamicum," The Journal of Sequencing and Mapping, vol. 4:403-404 (1994).
Bonamy, Celine, et al., "Identification of IS 1206, a Corynebacterium glutamicum IS3-related insertion sequence and phylogenetic analysis," Molecular Microbiology, vol. 14(3):571-581 (1994).
Bonnassie, S., et al., "Nucleotide sequence of the dapA gene from Corynebacterium glutamicum," Nucleic Acids Research, vol. 18(21):6421(1990).
Börmann, E.R., et al., "Molecular analysis of the Corynebacterium glutamicum gdh gene encoding glutamate dehydrogenase," Molecular Microbiology, vol. 6(3):317-326 (1992).
Chen, Chain-Chi, et al., "The cloning and nucleotide sequence of a Corynebacterium glutamicum 3-deoxy-D-arabinoheptulosante-7-phosphate synthase gene," FEMS Micrkobiology Letters, vol. 107:223-230 (1993).
Cianciotto, Nicholas, et al., "DNA sequence homology between attB-related sites of Corynebacterium diphtheriae, Corynebacterium ulcerans, Corynebacterium glutamicum, and the attP site of γ-Corynephage," FEMS Microbiology Letters, vol. 66:299-302 (1990).
Correia, Antonio, et al., "Cloning and characterization of an IS-like element present in the genome of Brevibacterium lactofermentum ATCC 13869," Gene, vol. 170:91-94 (1996).
Dusch, Nicole, et al., "Expression of the Corynebacterium glutamicum panD Gene Encoding L-Aspartate-α-Decarboxylase Leads to Pantothenate Overproduction in Escherichia coli," Applied and Environmental Microbiology, vol. 65(4):1530-1539 (1999).
Eikmanns, Bernhard J., et al., "Nucleotide sequence, expression and transscriptional analysis of the Corynebacterium glutamicum gltA gene citrate synthase," Microbiology, vol. 140:1817-1828 (1994).
Eikmanns, Bernhard J., et al., "Identification, Sequence Analysis, and Expression of a Corynebacterium glutamicum Gene Cluster Encoding in the Three Glycolytic Enzymes Glycerldehyde-3-Phosphate Dehydrogenase, 3-Phosphoglycerate Kinase, and Triosephosphate Isomerase," Journal of Bacteriology, vol. 174(19):6076-6086 (1992).
Eikmanns, Bernhard J., et al., "Cloning, Sequence Analysis, Expression, and Inactivation of the Corynebacterium glutamicum icd Gene Encoding Isocitrate Dehydrogenase and Biochemical Characterization of the Enzyme," Journal of Bacteriology, vol. 177(3):774-782 (1995).
Eikmanns, Bernhard J., et al., "The phosphoenolpyruvate carboxylase gene of Corynebacterium glutamicum: Molecular cloning, nucleotide sequence, and expression," Mol. Gen. Genet., vol. 218:330-339 (1989).
Fitzpatrick, R., et al., "Construction and characterization of recA mutant strains of Corynebacterium glutamicum and Brevibacterium lactofermentum,"Appl. Microbiol. Biotechnol., vol. 42:575-580 (1994).
Follettie, Max T., et al., "Molecular Cloning and Nucleotide Sequence of the Corynebacterium glutamicum pheA Gene," Journal of Bacteriology, vol. 167(2):695-702 (1986).
Fouet, Agnes, et al., "Bacillus subtilis sucrose-specific enzyme II of the phosphotransferase system: Expression in Escherichia coli and homolgy to enzymes II from enteric bacteria," Proc. Natl. Acad. Sci., vol. 84:8773-8777 (1987).
Han, K.-S., et al., "The molecular structure of the Corynebacterium glutamicum threonine synthase gene," Molecular Microbiology, vol. 4(10):1693-1702 (1990).
Heery, D.M., et al., "Nucleotide sequence of the Corynebacterium glutamicum trpE gene," Nucleic Acids Research, vol. 18(23):7138 (1990).
Heery, D.M., et al., "Cloning of the trp Gene Cluster from a Tryptophan-Hyperproducing Strain of Corynebacterium

*glutamicum*: Identification of a Mutation in the trp Leader Sequence," *Applied and Environmental Microbiology*, vol. 59(3):791-799 (1993).

Heery, David M., et al., "A Sequece from a Tryptophan-Hyperproducing Strain of *Corynebacterium glutamicum* Encoding Resistance to 5-Methyltryptophan," *Biochemical and Biophysical Research Communcations*, vol. 201(3):1255-1262 (1994).

Honrubia, M.P., et al., "Identification, characterization, and chromosomal organization of the *ftsZ* gene from *Brevibacterium lactofermentum*," *Mol. Gen. Genet.*, vol. 259:97-104 (1998).

Ishino, Shuichi, et al., "Nucleotide sequence of the meso-diaminopimelate D-dehydrogenase gene from *Corynebacterium glutamicum*," *Nucleic Acids Research*, vol. 15(9):3917 (1987).

Jäger, Wolfgang, et al., "A *Corynebacterium glutamicum* Gene Conferring Multidrug Resistance in the Heterologous Host *Escherichia coli*," *Journal Bacteriology*, vol. 179(7):2449-2451 (1997).

Jäger, Wolfgang, et al., "A *Corynebacterium glutamicum* gene encoding a two-domain protein similar to boitin carboxylases and biotin-carboxyl-carrier proteins," *Arch. Microbiol.*, vol. 166:76-82 (1996).

Jakoby, Marc, et al., "Isolation of the *Corynebacterium glutamicum* gtnAgene encoding glutamine synthetase I," *FEMS Microbiology Letters*, vol. 154:81-88 (1997).

Jakoby, Marc, et al., "Nitrogen regulation in *Corynebacterium glutamicum*: Isolation of genes involved and biochemical characterization of corresponding proteins," *FEMS Microbiology Letters*, vol. 173:303-310 (1999).

Jetten, Mike S., et al., "Structural and Functional Analysis of Pyruvate Kinase from *Corynebacterium glutamicum*," *Applied and Environmental Microbiology*, vol. 60(7):2501-2507 (1994).

Joliff, G., et al., "Cloning and nucleotide sequence of the *csp1* gene encoding PS1, one of two major secreted proteins of *Corynebacterium glutamicum*: the deduced N-terminal region of PS1 is similar to the *Mycobacterium* antigen 85 complex," *Molecular Microbiology*, vol. 6(16):2349-2362 (1992).

Kalinowski, J., et al., "Genetic and biochemical analysis of the aspartokinase from *Corynebacterium glutamicum*," *Molecular Microbiology*, vol. 5(5):1197-1204 (1991).

Kalinowski, Jöm, et al., "Aspartokinase gene *lysC*χ and *lys*βoverlap and are adjacent to the aspartate β-semialdehyde dehydrogenase gene *asd* in *Corynebacterium glutamicum*,"*Mol. Gen. Genet.*, vol. 224:317-324 (1990).

Schäfer, A. et al., "The *Corynebacterium glutamicum* cgIIM gene encoding a 5-cytosine in an McrBC-deficient *Echerichia coli* strain," *Gene*, 203(2):95-101 (1997).

Kimura, Eiichiro, et al., "Molecular Cloning of a Novel Gene, *dtsR*, Which Rescues the Detergent Sensitivity of a Mutant Derived from *Brevibacterium lactofermentum*,"*Biosci. Biotech. Biochem.*, vol. 60(10):1565-1570 (1996).

Kobayashi, Miki, et al., "Cloning, Sequencing, and Characterization of the *ftsZ* Gene from *Coryneform Bacteria*," *Biochemical and Biophysical Research Communications*, vol. 236:383-388 (1997).

Kronemeyer, Wolfgang, et al., "Structure of the *gluABCD* Cluster Encoding the Glutamate Uptake System of *Corynebacterium glutamicum*," *Journal of Bacteriology*, vol. 177(5):1152-1158 (1995).

Lee, Heung-Shick, et al., "Molecular Characterization of AceB, a Gene Encoding Malate Synthase in *Corynebacterium glutamicum*," *Journal of Microbiology and Biotechnology*, vol. 4(4):256-263 (1994).

Le Marrec, Claire, et al., "Genetic Charatcerization of Site-Specific Integration Functions of φAAU2 Infecting '*Arthrobacter aureus*' C70," *Journal of Bacteriology*, vol. 178(7):1996-2004 (1996).

Lepiniec, Loïc, et al., "Sorghum phosphoenopyruvate carboxylase gene family: structure, function and molecular evolution," *Plant Molecular Biology*, vol. 21:487-502 (1993).

Lichtinger, Thomas, et al., "Biochemical and Biophysical Characterization of the Cell Wall Porin of *Corynebacterium glutamicum*: The Channel Is Formed by a Low Molecular Mass Polypeptide," *Biochemistry*, vol. 37:15024-15032 (1998).

Ludwig, W., et al., "Phylogenetic relationships of *Bacteria* based on comparative sequence analysis of elongation factor Tu and ATP-synthase β-subunit genes," *Antonie van Leeuwenhoek*, vol. 64:285-305 (1993).

Malubres, Marcos, et al., "Analysis said Expression of the *thrC* Gene of *Brevibacterium lactofermentum* and Characterization of the Encoding Threonine Synthase," *Applied and Environmental Microbiology*, vol. 60(7):2209-2219 (1994).

Marcel, T., et al., "Nucleotide sequence and organization of the upstream region of the *Corynebacterium glutamicum lysA* gene," *Molecular Microbiology*, vol. 4(11):1819-1830 (1990).

Mateos, Luis M., et al., "Nucleotide sequence of the homoserine kinase (*thrB*) gene of *Brevibacterium lactofermentum*,"*Nucleotide Acids Research*, vol. 15(9):3922 (1987).

Mateos, Luis M., et al., "Nucleotide sequence of the homoserine dehydrogenase (*thr B*) gene of *Brevibacterium lactofermentum*,"*Nucleotide Acids Research*, vol. 15(24):10598 (1987).

Matsui, Kazuhiko, et al., "Complete nucleotide and deduced amino acid sequences of the *Brevibacterium lactofermentum* tryptophan operon," *Nucleotide Acids Research*, vol. 14(24):10113-10114 (1986).

Möckel, Bettina, et al., "Functional and Structural Analyses of Threonine Dehydratase from *Corynebacterium glutamicum*," *Journal of Bacteriology*, vol. 174(24):8065-8072 (1992).

Molenaar, Douwe, et al., "Biochemical and genetic characterization of the membrane-associated malate dehydrogenase (acceptor) from *Corynebacterium glutamicum*," *Eur. J. Biochem.*, vol. 254-403 (1998).

Moreau, Sylvia, et al., "Site-specific integration of corynephage Φ16: construction of an integration vector," *Microbiology*, vol. 145:539-548 (1999).

Moreau, Sylvie, et al., "Analysis of the Integration Functions of Φ304L: An Integrase Module among Cornephages," *Virology*, vol. 255:150-159 (1999).

O'Gara, James P., et al., "Mutations in the *trpD* Gene of *Corynebacterium glutamicum* Confer 5-Methyltryptophan Resistance by Encoding a Feedback-Resistant Anthranilate Phosphoribosyltranferase,"*Applied and Environmental Microbiology*, vol. 61:(12):4477-4479 (1995).

Oguiza, José A., et al., "A Gene Encoding Arginyl-tRNA Synthetase Is Located in the Upstream Region of the lysA Gene in Brevibacterium lactofermentum: Regulation of argS-lysA Cluster Expression by Arginine," *Journal of Bacteriology*, vol. 175(22):7356-7362 (1993).

Oguiza, José A., et al., "Molecular Cloning, DNA Sequence Analysis, and Characterization of the *Corynebacterium diphtheriae* dtxR Homolog from *Brevibacterium lactofermentum*," *Journal of Bacteriology*, vol. 177(2):465-467 (1995).

Oguiza, José A., et al., "Multiple Sigma Factor Genes in *Brevibacterium lactofermentum*: Characterization of *sigA* and *sigB*," *Journal of Bacteriology*, vol. 178(2):550-553 (1996).

Oguiza, JoséA., et al., "The GalE gene encoding the UDP-galactose 4-epimerase of *Brevibacterium lactofermentum* is coupled transcriptionally to the *dmdR* gene," *Gene*, vol. 177:103-107 (1996).

O'Regan, Michael, et al., "Cloning and nucleotide sequence of the phosphoenolpyuvate carboxylase-coding gene of *Corynebacterium glutamicum* ATCC13032,"*Gene*, vol. 77:237-251 (1989).

Lee, J.K. et al. "Nucleotide sequence of the gene encoding the Corynebacterium glutamicum mannose enzyme II and analyses of the deduced protein sequence," *Microbiol. Lett.*, 119(1-2):137-145 (1994).

Park, Yong-Ha, et al., "Phylogenetic Analysis of the *Coryneform Bacteria* by 5S rRNA Sequences," *Journal of Bacteriology*, vol. 169(5):1801-1806 (1987).

Pascual, Cristina, et al., "Phylogenetic Analysis of the Genus *Corynebacterium* Based on 16S rRNA Gene Sequences," *International Journal Systematic Bacteriology* vol. 45(4):724-728 (1995).

Pátek, M., et al., "Analysis of the *leuB* gene from *Corynebacterium glutamicum*," *Appl Microbiol Biotechnol*, vol. 50:42-47 (1998).

Pátek, Miroslav, et al., "Leucine Synthesis in *Corynebacterium glutamicum*: Enzyme Activities, Structure of *leuA*, and Effect of *leuA*

Inactivation on Lysine Synthesis," *Applied and Environmental Microbiology*, vol. 60(1):133-140 (1994).

Pátek, Miroslav, et al., "Promoters from *Corynebacterium glutamicum*: cloning, molecular analysis and search for a consensus motif,"*Microbiology*, vol. 142:1297-1309 (1996).

Páték, M., et al., "Identification and transcriptional analysis of the *dapB*-ORF2-*dapA*-ORF4 operon of *Corynebacterium glutamicum*, encoding two enzymes involved in L-lysine synthesis," *Biotechnology Letters*, vol. 19(11):1113-1117 (1997).

Peoples, O.P., et al., "Nucleotides sequence and fine structural analysis of the *Corynebacterium glutamicum hom-thrB* operon," *Molecular Microbiology*, vol. 2(1):63-72 (1988).

Peter, Heidi, et al., "*Corynebacterium glutamicum* Is Equpped with Four Secondary Carriers for Compatible Solutes: Identification, Sequencing, and Characterization of the Proline/Ectoine Uptake System, ProP, and the Ectoine/Proline/Glycine Betaine Carrier, EctP,"*Journal of Bacteriology*, vol. 180(22):6005-6012 (1998).

Peter, Heidi, et al., "Isolation of the *putP* gene of *Corynebacterium glutamicum* and characterization of a low-affinity uptake system for compatible solutes," *Arch Microbiol*, vol. 168:143-151 (1997).

Peter, Heidi, et al., "Isolation, Characterization, and Expression of the *Corynebacterium glutamicum betP* Gene, Encoding the Transport System for the Compatible Solute Glycine Betaine," *Journal of Bacteriology*, vol. 178(17):5229-5234 (1996).

Peters-Wendisch, Petra G., et al., "Pyruvate carboxylase from *Corynebacterium glutamicum*: characterization, expression and inactivation of the *pyc* gene,"*Microbiology*, vol. 144: 915-927 (1998).

Peyret, J.L., et al., "Characterization of the *cspB* gene encoding PS2, an ordered surface-layer protein in *Corynebacterium glutamicum*,"*Molecular Biology*, vol. 9(1):97-109 (1993).

Pisabarro, Agustin, et al., "A Cluster of Three Genes (*dapA, orf2, and dapB*) of *Brevibacterium lactofermentum* Encodes Dihydrodipicolinate Synthase, Dihydrodipicolinate Reductase, and a Third Polypeptide of Unknown Function," *Journal of Bacteriology*, vol. 175(9):2743-2749 (1993).

Rainey, Frederick A., et al., "Phylogenetic analysis of the genera *Rhodococcus and Nocardia* and evidence for the evolutionary origin of the genus *Nocaria* from within the radiation of *Rhodococcus* species," *Microbiology*, vol. 141:523-528 (1995).

Ramos, Adoración, et al., "Cloning, sequencing and expression of the gene encoding elongation factor P in the amino-acid producer *Brevibacterium lactofermentum* (*Corynebacterium glutamicum* ATCC 13869)," *Gene*, vol. 198:217-222 (1997).

Reinscheid, Deiter, J., et al., "Cloning, sequence analysis, expression and inactivation of the *Corynebacterium glutamicum pta-ack* operon encoding phosphotransacetylase and acetate kinase," *Microbiology*, vol. 145:503-513 (1999).

Reinscheid, Deiter J., et al., "Characterization of the Isocitrate Lyase Gene from *Corynebacterium glutamicum* and Biochemical Analysis of the Enzyme," *Journal of Bacteriology*, vol. 176(12):3474-3483 (1994).

Reinscheid, Deiter J., et al., "Malate synthase from *Corynebacterium glutamicum*: sequence analysis of the gene and biochemical characterization of the enzyme," *Microbiology*, vol. 140:3099-3108 (1994).

Roller, Carsten, et al., "Gram-positive bacteria with a high DNA G+C content are characterized by a common insertion within their 23S rRNA genes," *Journal of General Microbiology*, vol. 138:1167-1175 (1992).

Rossol, Ingrid, et al., "The *Corynebacterium glutamicum* aecD Gene Encodes a C-S Lyase with ⊕,β-Elimination Activity That Degrades Aminoethylcysteine," *Journal of Bacteriology*, vol. 174(9):2968-2977 (1992).

Ruimy, Raymond, et al. "Phylogeny of the Genus *Corynebacterium* Deduced from Analyses of Small-Subunit Ribosomal DNA Sequences," *International Journal of Systematic Bacteriology*, vol. 45(4):740-746 (1995).

Sahm, Hermann, et al., "D-Pantothenate Synthesis in *Corynebacterium glutamicum* and Use of *panBC* and Genes Encoding L-Valine Synthesis for D-Pantothenate Overproduction,"*Applied and Environmental Microbiology*, vol. 65(5):1973-1979 (1999).

Sakanyan, Vehary, et al., "Genes and enzymes of the acetyl cycle of arginine biosynthesis in *Corynebacterium glutamicum*:enzyme evolution in the early steps of the arginine pathway," *Microbiology*, vol. 142:99-108 (1996).

Sano, Konosuke, et al., "Structure and function of the *trp* operon control regions of *Brevibacterium lactofermentum*, a glutamic-acid-producing bacterium," *Gene*, vol. 53:191-200 (1987).

Schäfer, Andreas, et al., "Cloning and Characterization of a DNA Region Encoding a Stress-Sensitive Restriction System from *Corynebacterium glutamicum* ATCC 13032 and Analysis of Its Role in Intergeneric Conjunction with *Escherichia coli*,"*Journal of Bacteriology*, vol. 176(23):7309-7319 (1994).

Seep-Feldous, A.J., et al., "Molecular analysis of the *Corynebacterium glutamicum lysl* gene involved in lysine uptake," *Molecular Microbiology*, vol. 5(12):2995-3005 (1991).

Serebrijksi, I, et al., "Multicopy Suppression by *asd* Gene and Osmotic Stress-Dependent Complementation by Heterologous *proA* Mutants," *Journal of Bacteriology*, vol. 177(24):7255-7260 (1995).

Serebriiskii, Ilya G., et al., "Two new members of the BioB superfamily: cloning, sequencing and expression of *bioB* genes of *Methtlobacillus flagellatum* and *Corynebacterium glutamicum*," *Gene*, vol. 175:15-22 (1996).

Siewe, Ruth M. et al., "Funtional and Genetic Characterization of the (Methyl)ammonium Uptake Carrier of *Corynebacterium glutamicum*," *The Journal of Biological Chemistry*, vol. 271(10):5398-5403 (1996).

Usuda, Yoshihiro, et al., "Molecular cloning of the *Corynebacterium glutamicum* ('*Brevibacterium lactofermentum*' AJ12036) *odhA* gene encoding a novel type of 2-oxoglutarate dehydrogenase," *Microbiology*, vol. 142:3347-3354 (1996).

Vertés, Alain A., et al., "Isolation and characterization of IS31831, a transposable element from *Corynebacterium glutamicum*," *Molecular Microbiology*, vol. 11(4):739-746 (1994).

von der Osten, C.H., et al., "Molecular cloning, nucleotide sequence and fine-structural analysis of the *Corynebacterium glutamicum fda* gene: structural comparison of *C. glutamicum* fructose-1,6-biphosphate aldolase to class I to class II aldolase," *Molecular Microbiology*, vol. 33(11):1625-1637 (1989).

Vrljic, Marina, et al., "A new type of transporter with a new type of cellular function: L-lysine export from *Corynebacterium glutamicum*," *Molecular Microbiology*, vol. 22(5):815-826 (1996).

Wachi, M., et al., "A *murC* gene from *coryneform bacteria*,"*Appl Microbiol Biotechnol*, vol. 51:223-228 (1999).

Wehmeier, Lutz, et al., "The role of the *Corynebacterium glutamicum rel* gene in (p)ppGpp metabolism," *Microbiology*, vol. 144:1853-1862 (1998).

Wehrmann, Axel, et al., "Different Modes of Diamniopimelate Synthesis and Their Role in Cell Wall Integrity: a Study with *Corynebacterium glutamicum*," *Journal of Bacteriology*, vol. 180(12):3195-3165 (1998).

Wehrmann, Axel, et al., "Analysis of different DNA fragments of *Corynebacterium glutamicum* complementing dapE of *Escherichia coli*," *Microbiology*, vol. 140:3349-3356 (1994).

Wehrmann, Axel, et al., "Functional Analysis of Sequences Adjacent to *dapE* of *Corynebacterium glutamicum* Reveals the Presence of *aroP*, Which Encodes the Aromatic Amino Acid Transporter," *Journal of Bacteriology*, vol. 177(20):5991-5993 (1995).

Yeh, Patrice, et al., "Nucleotide sequence of the *lysA* gene of *Corynebacterium glutamicum* and possible mechanisms for modulation of its expression," *Mol Gen Gent*, vol. 212:112-119 (1988).

GenBank Accession No. A09073 for DNA fragment coding for phosphoenolpyruvat corboxylase, recombiant DNA carrying said fragment strains, strains carrying the recombinant DNA and method for producing L-amino acids using said strains, Bachmann, B. et al, Apr. 14, 2005.

GenBank Accession No. A45579 for Production of L-isoleucine by means of recombinant micro-organisms with deregulated threonine dehydratase, Moeckel, B. et al, Mar. 7, 1997.

GenBank Accession No. A45581, Moeckel, B. et al, "Production of L-Isoleucine by Means of Recombinant Micro-Organisms with Deregulated Threonine Dehydratase." Mar. 7, 1997.

GenBank Accession No. A45583, Moeckel, B. et al, "Production of L-Isoleucine by Means of Recombinant Micro-Organisms with Deregulated Threonine Dehydratase." Mar. 7, 1997.
GenBank Accession No. A45585, Moeckel, B. et al, "Production of L-Isoleucine by Means of Recombinant Micro-Organisms with Deregulated Threonine Dehydratase." Mar. 7, 1997.
GenBank Accession No. A45587 for Production of L-Isoleucine by means of recombinant micro-organisms with deregulated threonine dehydratase, Moeckel, B. et al, Mar. 7, 1997.
GenBank Accession No. AA011641 for Generation and analysis of 280,000 human expressed sequence tags, Hillier, L. et al, May 9, 1997.
GenBank Accession No. AA655226 for The WashU-HHMI Mouse EST Project, Marra, M. et al, Nov. 4, 1997.
GenBank Accession No. AA704727 for WashU-NCI human EST Project, Hillier, L. et al, Dec. 24, 1997.
GenBank Accession No. AB003132 for Cloning, sequencing, and characterization of the ftsZ gene from *coryneform bacteria*, Kobayashi, M. et al, Aug. 4, 1997.
GenBank Accession No. AB015023 for A murC gene from *coryneform bacteria*, Wachi, M. et al, Dec. 15, 2001.
GenBank Accession No. AB015853 for Expression in *Escherichia coli* of a new multidrug efflux pump, MexXY, from *Pseudomonas aeruginosa*, Mine, T. et al, Aug. 2, 2000.
GenBank Accession No. AB018530 for Molecular cloning of a novel gene, dtsR, which rescues the detergent sensitivity of a mutant derived from *Brevibacterium lactofermentum*, Kimura, E. et al, Oct. 16, 1998.
GenBank Accession No. AB018531 for The role of DtsR2 in the glutamate-production in *coryneform bacteria*, Kimura, E. et al, Oct. 16, 1998.
GenBank Accession No. AB020624 for Isolation of the murI gene from *Brevibacterium lactofermentum* ATCC 13869 encoding D-glutamate racemase, Malathi, K.C. et al, Jul. 24, 1999.
GenBank Accession No. AB023377 for Nucleotide sequence of the *Corynebacterium glutamicum* transketolase gene, Ikeda, M. et al, Feb. 20, 99.
GenBank Accession No. AB024708 for *Corynebacterium glutamicum* gltBD gene, Kanno, S. et al, Mar. 13, 1999.
GenBank Accession No. AB025424 for *Brevibacterium lactofermentum* ATCC 13869 acn gene for Acnoitase, Nakamura, J. et al, Apr. 3, 1999.
GenBank Accession No. AB027714 for Cryptic plasmid pCG1 of *Corynebacterium glutamicum*, Yonetani, Y. et al, Jun. 1, 1999.
GenBank Accession No. AB027715 for Plasmid pCG11 of *Corynebacterium glutamicum*, Yonetani, Y. et al, Jun. 1, 1999.
GenBank Accession No. AC004295 for Sequencing of Drosphila chromosome 2R, region 55C1-55C4, Celniker, S.E. et al, Jul. 29, 1998.
GenBank Accession No. AC005019 for Toward a complete human genome sequence, Sulston, J.E. et al, Oct. 15, 2003.
GenBank Accession No. AC006044 for Toward a complete human genome sequence, Sulston, J.E. et al, Oct. 8, 2003.
GenBank Accession No. AC006474 for The DNA sequence of human chromosome 7, Hillier, L.W. et al, Jan. 27, 2004.
GenBank Accession No. AC007784 for The sequencing of Drosphila chromosome 2R, region 43F-44-A, Celniker, S.E. et al, Mar. 21, 2001.
GenBank Accession No. AC007739 for The sequence of Homo sapiens BAC clone RP11-91L3, Hou, S. et al, Apr. 16, 2005.
GenBank Accession No. AC008403, DOE Joint Genome Institute and Stanford Human Genome Center, for Homo sapiens chromosome 19 clone CTC-273B12, complete sequence, Mar. 22, 2003.
GenBank Accession No. AC009298 for The sequence of Homo sapiens BAC clone RP11-1716, Nguyen, C. et al, Apr. 15, 2005.
GenBank Accession No. AC010187 for Homo sapiens chromosome 12 clone RP11-389O9, Working Draft Sequence, 40 unordered pieces, Muzny, D.M. et al, Jan. 8, 2003.
GenBank Accession No. AC011647 for Homo sapiens chromosome 11, clone RP11-15D18, Birren, B. et al, Jun. 18, 2002.
GenBank Accession No. AD000002 for *Mycobacterium tuberculosis*, Du, L., Dec. 10, 1996.

GenBank Accession No. AD000016 for *Mycobacterium tuberculosis*, Du, L., Dec. 3, 1996.
GenBank Accession No. AE000654 for The complete genome sequence of the gastric pathogen Helicobacter pylori, Tomb, J.-F. et al, Apr. 6, 1999.
GenBank Accession No. AF001552 for genome duplications and other features in 12 Mb of DNA sequence from human chromosome 16p and 16q, Loftus, B.J. et al, Jan. 1, 2000.
GenBank Accession No. AF005242, Chun, J.Y. et al, "Molecular cloning and analysis of the argC gene from *Corynebacterium glutamicum*," Biochem. Mol. Biol. Int., vol. 46(3):437-447 (1998), Jul. 23, 2001.
GenBank Accession No. AF005635 for *Corynebacterium glutamicum*, Reid, S.J. et al, Jun. 14, 1999.
GenBank Accession No. AF030405 for Molecular cloning of the histidine biosynthetic genes from *Corynebacterium glutamicum*, Jung, S.I. et al, Nov. 13, 1997.
GenBank Accession No. AF030520, Ko, S.Y. et al, "Molecular cloning of the argG gene from *Corynebacterium glutamicum*," Nov. 19, 1997.
GenBank Accession No. AF031518, Chun, J.Y. et al, "Cloning of the argF gene encoding the ornithine carbamoyltransferase from *Corynebacterium glutamicum*," Mol. Cells, vol. 9(3):333-337 (1999), Jun. 13, 2001.
GenBank Accession No. AF036932 for Molecular cloning of the aroD gene from *Corynebacterium glutamicum*, Park, K.-Y. et al, Dec. 13, 1997.
GenBank Accession No. AF038548 for Sequence of the *Corynebacterium glutamicum* Pyruvate carboxylase gene, Koffas, M.A. et al, Aug. 25, 2000.
GenBank Accession No. AF038651 for The role of the *Corynebacterium glutamicum* rel gene in (p)ppGpp metabolism, Welmeier, L. et al, Mar. 15, 2001.
GenBank Accession No. AF041436, Ko. S.-Y. et al, "The argR gene *Corynebacterium glutamicum*," Jan. 5, 1999.
GenBank Accession No. AF045998 for Molecular cloning of the histidine biosynthetic genes from *Corynebacterium glutamicum*, Jund, S.I. et al, Feb. 19, 1998.
GenBank Accession No. AF048764, Park. M.Y. et al, "Molecular cloning of the argH gene encoding *argininosuccinate lyase* from *Corynebacterium glutamicum*." Jul. 1, 1998.
GenBank Accession No. AF049897, Park, M.Y. et al, "Molecular cloning of the Arginine Biosynthetic Gene from *Corynebacterium glutamicum*." Jul. 1, 1998.
GenBank Accession No. AF050109 for The function of the inhA gene in mycolic acid synthesis of *Corynebacterium glutamicum*, Sayyada-Hafeez, A. et al, Nov. 19, 2002.
GenBank Accession No. AF050166, Kwon, J.H. et al, "Cloning of the hitidine biosynthetic genes from *Corynebacterium glutamicum*: organization and analysis of the hisG and hisE genes," Can. J. Microbiol., vol. 46(9):848-855 (2000), Apr. 26, 2002.
GenBank Accession No. AF051846 for *Corynebacterium glutamicum*, Jung, S.I. et al, Mar. 12, 1998.
GenBank Accession No. AF052652 for Isolation and Anaylsis of metA, a Mentionine Biosynthetic Gene Encoding Homoserine Acetyltransferase in *Corynebacterium glutamicum*, Park, S.-D. et al, Mar. 19, 1998.
GenBank Accession No. AF053071 for Cloning and analysis of the aroB gene encoding dehyddroquinate synthase from *Corynebacterium glutamicum*, Han, M.A. et al, Apr. 26, 2002.
GenBank Accession No. AF060558 for *Corynebacterium glutamicum*, Juns S.I. et al, Apr. 29, 1998.
GenBank Accession No. AF086704 for *Corynebacterium glutamicum*, Kwon, J.H. et al, Feb. 8, 1999.
GenBank Accession No. AF114233 for Cloning and molecular analysis of the *Corynebacterium glutamicum* ASO19 and aroA gene, O'Donohue, M. et al, Feb. 7, 1999.
GenBank Accession No. AF116184, Dusch, N. et al, "Expression of the *Corynebacterium glutamicum* panD gene encoding L-aspartate-alpha-decarboxylase leads to pantothenate overproduction in *Escherchia coli*," Appl. Environ. Microbiol., vol. 65(4):1530-1539 (1999), May 2, 1999.

GenBank Accession No. AF124518 for The cloning and phylogenetic analysis of the 3-dehyroquinase gene from *Corynebacterium glutamicum*, Joy, J. et al, May 18, 1999.
GenBank Accession No. AF124600 for Genetic aspects of the prechorismate pathway in *Corynebacterium glutamicum*, Burke, K.G. et al, May 4, 1999.
GenBank Accession No. AF145897 for Comparison of inhA gene of *Corynebacterium glutamicum* with its mutants and other related species, Hafeez, S. A. et al, Nov. 19, 2002.
GenBank Accession No. AF145898 for Comparison of inhA gene for *Corynebacterium glutamicum* with its mutants and other related species, Hafeez, S.A. et al, Nov. 19, 2002.
GenBank Accession No. AI190741, NCI-CGAP http://www.ncbi.nlm.nih.gov/ncicqap, for National Cancer Institute, Cancer Genome Anatomy Project (CGAP), Tumor Gene Index, Oct. 28, 1998.
GenBank Accession No. AJ001436 for *Corynebacterium glutamicum* is equipped with four secondary carriers for compatible solutes: identification, sequencing, and characterization of the proline/ectoine uptake system, ProP, and the ectoine/proline/glycine betaine carrier, EctP, Peter, H. et al, Nov. 20, 1998.
GenBank Accession No. AJ004934, Wehrmann, A. et al, "Different modes of diaminopimelate synthesis and their role in cell wall integrity: a study with *Corynebacterium glutamicum*,"*J. Bacteriol.*, vol. 180(12):3159-3165 (1998), Jun. 17, 1998.
GenBank Accession No. AJ007732, Jakoby, M.J. et al, "Ammonium uptake in *Corynebacterium glutamicum* is regulated on the level of expression and enzyme activity." Apr. 15, 2005.
GenBank Accession No. AJ010319 for Nitrogen regulation in *Corynebacterium glutamicum*: isolation of genes involved and biochemical characterization of corresponding proteins, Jakoby, M. et al, Apr. 15, 2005.
GenBank Accession No. AJ132968 for Construction and application of new *Corynebcaterium glutamicum* vectors, Jakoby, M.J. et al, May 4, 1999.
GenBank Accession No. AJ224946 for Biochemical and genetic characterization of the membrane-associated malate dehydrogenase (acceptor) from *Corynebacterium glutamicum*, Molenaar, D. et al, Aug. 11, 1998.
GenBank Accession No. AJ238250 for Functions of the membrane-associated and cytoplasmic malate dehydrogenase in the citric acid cycle of *Corynebacterium glutamicum*, Molenaar, D. et al, Dec. 3, 2000.
GenBank Accession No. AJ238703 for Biochemical and biophysical characterization of the cell wall porin of *Corynebacterium glutamicum*: the channel is formed by a low molecular mass polypeptide, Lichtinger, T. et al, May 7, 1999.
GenBank Accession No. AL021841, Cole, S.T. et al, "Deciphering the biology of Mycobacterium tuberculosis from the complete genome sequence," *Nature*, vol. 393(6685):537-544 (1998), Sep. 2, 2002.
GenBank Accession No. AL022075 for Deciphering the biology of *Mycobacterium tuberculosis*from the complete genome sequence, Cole, S.T. et al, Aug. 2, 2002.
GenBank Accession No. AL022268 for A set ordered cosmids and a detailed genetic and physical map for the 8 Mb Streptomyces coelicotor A3 (2) chromosome, Redenbach, M. et al, May 12, 2002.
GenBank Accession No. AL023591 for Use of an ordered cosmid library to deduce the genomic organization of *Mycobacterium laprae*, Eiglmeier, K. et al, Apr. 16, 2005.
GenBank Accession No. AL035159 for Use of an ordered cosmid library to deduce the genomic organization of *Mycobacterium laprae*, Eiglmeier, K. et al, Apr. 16, 2005.
GenBank Accession No. AL081676 for Arabidopsis thaliana, Salanoubat, M. et al, Jun. 28, 1999.
GenBank Accession No. AL096814 for Homo sapiens, Sehra, H., May 18, 2005.
GenBank Accession No. AL101527 for Drosphila melanogaster, Genoscope, Jul. 26, 1999.
GenBank Accession No. AP000004 for Complete sequence and gene organization of the genome of a hyper-thermophillic archaebacterium, Pyrococcus horikoshii OT3, Kawarabayasi, Y. et al, May 27, 2004.

GenBank Accession No. AP000140 for Homo sapiens 911,949bp genomic DNA of 21q21.2 (Region: LL56-APP Clone Range: B2291C14-R44F3), Hattori, M. et al, Jan. 8, 2000.
GenBank Accession No. AP000228 for Homo sapiens 75,698bp genomic DNA of 21q21.2, Hattori, M. et al, Nov. 20, 1999.
GenBank Accession No. AQ128685 for Sequence-tagged connectors: A sequence approach to mapping and scanning the human genome, Mahairas, G.G. et al, Sep. 23, 1998.
GenBank Accession No. AQ364540 for A BAC End Sequencing Framework to Sequence the Rice Genome, Wing, R.A. et al, Dec. 16, 1999.
GenBank Accession No. AQ463737 for Sequence-tagged connectors: A sequence approach to mapping and scanning the human genome, Mahairas, G.G. et al, Apr. 23, 1999.
GenBank Accession No. B10133 for BAC End Sequences at ATGC, Feng J. et al. May 14, 1997.
GenBank Accession No. C97772 for Rice cDNA from callus, Sasaki, T. et al, Apr. 4, 2002.
GenBank Accession No. D17429 for Isolation and characterization of IS31831, a transposable element from *Corynebacterium glutamicum*, Vertes, A.A. et al, Feb. 4, 1999.
GenBank Accession No. D84102 for Molecular cloning of the *Corynebacterium glutamicum* ('Brevibacterium lactofermentum' AJ12036) odhA gene encoding a novel type of 2-oxoglutarate dehydrogenase, Usuda, Y. et al, Feb. 6, 1999.
GenBank Accession No. D84432 for Systematic sequencing of the 283 kb 210 degrees-232 degrees region of the Bacillus subtilis genome containing the skin element and many sporulation genes, Mizuno, M. et al, Feb. 6, 1999.
GenBank Accession No. D87915 for Molecular cloning and characterization of the obg gene of Streptomyces griseus in relation to the onset of morphological differentiation, Okamoto, S. et al, Feb. 7, 1999.
GenBank Accession No. E01358 for Production of L-Thereonine and L-Isoleucine, Katsumata, R. et al, Sep. 29, 1997.
GenBank Accession No. E01359 for Production of L-Thereonine and L-Isoleucine, Katsumata, R. et al, Sep. 29, 1997.
GenBank Accession No. E01375 for Tryptophan operon, peptide and protien coded thereby, utilization of Tryptophan operon gene expression and producation of Tryptophan, Matsui, K. et al, Sep. 29, 1997.
GenBank Accession No. E01376 for Trytophan Operon, Peptide and Protein Coded Thereby, Utilization of Tryptophan Operon Gene Expression and Production of Tryptophan, Matsui, K. et al, Sep. 29, 1997.
GenBank Accession No. E01377 for Tryptophan Operon, Peptide and Protein Coded Thereby, Utilization of Tryptophan Operon Gene Expression and Production of Tryptophan, Matsui, K. et al, Sep. 29, 1997.
GenBank Accession No. E03937 for DNA fragment containing gene capable of coding biotin synthetase and its utilization, Hatakeyama, K. et al, Sep. 29, 1997.
GenBank Accession No. E04040 for Gene Coding Diaminopelargonic Acid Aminotransferase and Desthiobiotin Synthase and its Utilization, Kohama, K. et al, Sep. 29, 1997.
GenBank Accession No. E04041 for Gene Coding Diaminopelargonic Acid Aminotransferase and Desthiobiotin Synthase and its Utilization, Kohama,, K. et al, Sep. 29, 1997.
GenBank Accession No. E04307, Kurusu, Y. et al, "Gene DNA coding aspartase and utilization there." Sep. 29, 1997.
GenBank Accession No. E04376 for Gene Manisfestation Controlling DNA, Katsumata, R. et al, Sep. 29, 1997.
GenBank Accession No. E04377 for Gene Manisfestation Controlling DNA, Katsumata, R. et al, Sep. 29, 1997.
GenBank Accession No. E04484 for Production of L-Phenylalanine by Fermentation, Sotouchi, N. et al, Sep. 29, 1997.
GenBank Accession No. E05108 for Gene DNA Coding Aspartokinase and its Use, Fugono, N. et al, Sep. 29, 1997.
GenBank Accession No. E05112 for Gene DNA Coding Dihydrodipicolinic Acid Synthetase and its Use, Hatakeyama, K. et al, Sep. 29, 1997.
GenBank Accession No. E05776 for Gene DNA Coding Diaminopimelic Acid Dehydrogenase and its Use, Kobayashi, M. et al, Sep. 29, 1997.

GenBank Accession No. E05779 for Gene DNA Coding Theronine Synthase and its Use, Kohama, K. et al, Sep. 29, 1997.
GenBank Accession No. E06110 for Production of L-Phenylalanine by Fermentation Method, Kikuchi, T. et al, Sep. 29, 1997.
GenBank Accession No. E06111 for Production of L-Phenylalanine by Fermentation Method, Kikuchi, T. et al, Sep. 29, 1997.
GenBank Accession No. E06146 for Gene Capable of Coding Acetohydroxy Acid Synthase and its, Inui, M. et al, Sep. 29, 1997.
GenBank Accession No. E06825 for Mutant Aspartokinase Gene, Sugimoto, M. et al, Sep. 29, 1997.
GenBank Accession No. E06826 for Mutant Aspartokinase Gene, Sugimoto, M. et al, Sep. 29, 1997.
GenBank Accession No. E06827 for Mutant Aspartokinase Gene, Sugimoto, M. et al, Sep. 29, 1997.
GenBank Accession No. E07701 for Gene DNA Participating in Integration of Membraneous Protein to, Honno, N. et al, Sep. 29, 1997.
GenBank Accession No. E08177 for Genetic DNA Capable of Coding Aspartokinase Released from Feedback Inhibition and its Utilization, Sato, Y. et al, Sep. 29, 1997.
GenBank Accession No. E08178 for Genetic DNA Capable of Coding Aspartokinase Released from Feedback Inhibition and its Utilization, Sato, Y. et al, Sep. 29, 1997.
GenBank Accession No. E08179 for Genetic DNA Capable of Coding Aspartokinase Released from Feedback Inhibition and its Utilization, Sato, Y. et al, Sep. 29, 1997.
GenBank Accession No. E08180 for Genetic DNA Capable of Coding Aspartokinase Released from Feedback Inhibition and its Utilization, Sato, Y. et al, Sep. 29, 1997.
GenBank Accession No. E08181 for Genetic DNA Capable of Coding Aspartokinase Released from Feedback Inhibition and its Utilization, Sato, Y. et al, Sep. 29, 1997.
GenBank Accession No. E08182 for Genetic DNA Capable of Coding Aspartokinase Released from Feedback Inhibition and its Utilization, Sato, Y. et al, Sep. 29, 1997.
GenBank Accession No. E08232 for Gene DNA Coding Acetohydroxy Acid Isomeroreductase, Inui, M. et al, Sep. 29, 1997.
GenBank Accession No. E08234 for Gene DNA Coding for Translocation Machinery of Protein, Asai, Y. et al, Sep. 29, 1997.
GenBank Accession No. E08643 for DNA Fragment Having Promoter Function in *Coryneform Bacterium*, Hatakeyama, K. et al, Sep. 29, 1997.
GenBank Accession No. E08646 for DNA Fragment Having Promoter Function in *Coryneform Bacterium*, Hatakeyama, K. et al, Sep. 29, 1997.
GenBank Accession No. E08649, Kohama, K. et al, "DNA fragment having promoter function in *coryneform bacterium*." Hatakeyama, K. et al, Sep. 29, 1997.
GenBank Accession No. E08900 for DNA Fragment Containig Gene Coding Dihyrodipicolinic Acid Rreductase and Utilization Thereof, Madori, M. et al, Sep. 29, 1997.
GenBank Accession No. E08901 for DNA Fragment Containing Gene Coding Dihyrodipicolinic Acid Decarboxylase and Utilization Thereof, Madori, M. et al, Sep. 29, 1997.
GenBank Accession No. E12594 for Production of L-Tryptophan, Hatakeyama, K. et al, Sep. 29, 1997.
GenBank Accession No. E12758 for Amplification of Gene Using Artificial Transposon, Moriya, M. et al, Sep. 29, 1997.
GenBank Accession No. E12759 for Amplification of Gene Using Artificial Transposon, Moriya, M. et al, Sep. 29, 1997.
GenBank Accession No. E12760 for Amplification of Gene Using Artificial Transposon, Moriya, M. et al, Sep. 29, 1997.
GenBank Accession No. E12764 for Amplification of Gene Using Artificial Transposon, Moriya, M. et al, Sep. 29, 1997.
GenBank Accession No. E12767 for Amplification of Gene Using Artificial Transposon, Moriya, M. et al, Sep. 29, 1997.
GenBank Accession No. E12770 for Amplification of Gene Using Artificial Transposon, Moriya, M. et al, Sep. 29, 1997.
GenBank Accession No. E12773 for Amplification of Gene Using Artificial Transposon, Moriya, M. et al, Sep. 29, 1997.
GenBank Accession No. E13655 for Glucose-6-Phosphate Dehydrogenase and DNA Capable of Coding the Same, Hatakeyama, K. et al, Apr. 27, 1998.

GenBank Accession No. L01508, Mockel, B. et al, "Functional and structural analyses of thernonin dehydratase from *Corynebacterium glutamicum*," *J. Bacteriol.*, vol. 174(24):8065-8072 (1992), Apr. 29, 1993.
GenBank Accession No. L07603 for The cloning and nucleotide sequence of a *Corynebacterium glutamicum* 3-deoxy-D-arabinoheptulosonate-7-phosphate synthase gene, Chen, C.C. et al, Apr. 26, 1993.
GenBank Accession No. L09232 for Isoleucine synthesis in *Corynebacterium glutamicum*: molecular analysis of the ilvB-ilvN-ilvC operon, Keilhauer, C. et al, Feb. 23, 1995.
GenBank Accession No. L18874 for Bacillus subtilis sucrose-specific enzyme II of the phosphotransferase system: expression in *Escherichia coli* and homology to enzymes II from enteric bacteria, Fouet, A. et al, Nov. 24, 1994.
GenBank Accession No. L27123 for Molecular characterization of aceB, a gene encoding malate synthase in *Coyrnebacterium glutamicum*, Lee, H.-S. et al, Jun. 8, 1995.
GenBank Accession No. L27126, Jetten, M.S., "Structural and functional analysis of pyruvate kinase from *Corynebacterium glutamicum*,"*Environ. Microbiol.*, vol. 60(7):2501-2507 (1994), Dec. 7, 1994.
GenBank Accession No. L28760 for Molecular characterization of acea, a gene encoding isocitrate lyase in *corynebacterium glutamicum*, H.-S. et al, Feb. 10, 1995.
GenBank Accession No. L35906, Oguiza, J.A., "Molecular cloning, DNA sequence analysis, and characterization of the *Corynebacterium diphtheria* dtxR homolog from *Brevibacterium lactofermentum*,"*J. Bacteriol.*, vol. 177(2):465-467 (1995) Mar. 6, 1996.
GenBank Accession No. L78820, Eiglmeier, K. et al, "Use of an ordered cosmid library to deduce the genomic organization of *Mycobacterium laprae*,"*Mol. Microbiol.*, vol. 7(2):197-208 (1993) Dec. 17, 2001.
GenBank Accession No. M13774, Follettie, M.T. et al, "Molecular cloning and nucleotide sequence of the *Corynebacterium glutamicum* pheA gene," *J. Bacteriol.*, vol.167(2):695-702 (1986), Apr. 26, 1993.
GenBank Accession No. M16175 for Phylogenetic analysis of the coryneform bacteria by 5S rRNA sequences, Park, Y.H. et al, Apr. 27, 1993.
GenBank Accession No. M16663 for Structure and function of the trp operon control regions of *brevibacterium lactofermentum*, a glutamic-acid producing bacterium, Sano, K. et al, Jul. 11, 2001.
GenBank Accession No. M16664 for Structure and function of the trp operon control regions of *Brevibacterium lactofermentum*, a glutamic-acid-producing bacterium, Sano, K. et al, Jul. 11, 2001.
GenBank Accession No. M25819 for Cloning and nucleotide sequence of the Phosphoenolpyruvate carboxylase-coding gene of *Corynebacterium glutamicum* ATCC13032, O'Regan, M. et al, Dec. 15, 1995.
GenBank Accession No. M85106 for Gram-positive bacteria with a high DNA G+C content are characterized by a common insertion within their 23S rRNA genes, Roller, C. et al, Apr. 26, 1993.
GenBank Accession No. M85107 for Gram-positive bacteria with a high DNA G+C content are characterized by a common insertion within their 23S genes, Roller C. et al, Apr. 29, 1993.
GenBank Accession No. M85108 for Gram-positive bacteria with a high DNA G+C content are characterized by a common insertion within their S23 rRNA genes, Roller, C. et al, Apr. 26, 1993.
GenBank Accession No. M89931, Rossol, I. et al, "The *Corynebacterium glutamicum* aecD gene encodes a C-S lyase with alpha, beta-elimination activity the degrades aminoethylcysteine," *J. Bacteriol.*, vol. 174(9):2968-2977 (1992), Feb. 8, 2002.
GenBank Accession No. S59299 for Cloning of the trp gene cluster from a tryptophan-hyperproducing strain of *Corynebacterium glutamicum*: identification of a mutation in the trp leader sequence, Herry, D.M. et al, Apr. 13, 2001.
GenBank Accession No. S76966 for Insertion sequence typing of *Mycobacterium tuberculosis*: characterization of widespread subtype with a single copy of IS6110, Fomukong, N.G. et al, May 11, 2005.

GenBank Accession No. U00016 for *Mycobacterium laprae*, Smith, D.R. et al, Mar. 1, 2004.
GenBank Accession No. U00018, Smith, D.R., *Mycobacterium laprae*, Smith D.R. et al, Mar. 1, 2004.
GenBank Accession No. U11545 for Complete nucleotide sequence of the *Corynebacterium glutamicum* ATCC 21850 trpD gene, O'Gara, J.P. et al, Jul. 8, 1994.
GenBank Accession No. U13922 for Cloning and characterization of a DNA region encoding a stress-sensitive restiction system from *Corynebacterium glutamicum* ATCC 13032 and analysis of its role in intergeneric conjugation with *Escherichia coli*, Schafer, A. et al, Feb. 3, 1998.
GenBank Accession No. U14965 for Molecular cloning and characterization of the recA gene from *Corynebacterium glutamicum* ASO19, Kerins, S.M. et al, Feb. 5, 1999.
GenBank Accession No. U31224, Ankri, S. et al, "Mutations in the *Corynebacterium glutamicum* proline biosynthetic pathway: a natural bypass of the proA step," *J. Bacteriol.*, vol. 178(15):4412-4419 (1996), Aug. 2, 1996.
GenBank Accession No. U31225, Ankri, S. et al, "Mutations in the *Corynebacterium glutamicum* proline biosynthetic pathway: a natural bypass of th proA step," *J. Bacteriol.*, vol. 178(15):4412-4419 (1996) Aug. 2, 1996.
GenBank Accession No. U31281 for Two new members of the bio B superfamily: cloning, sequencing and expression of bio B genes of *Methytobacillus flagellatum* and *Corynebacterium glutamicum*, Serebriiskii, I.G. et al, Nov. 21, 1996.
GenBank Accession No. U35023 for A *Corybacterium glutamicum* gene encoding a two-domain protein similar to biotin carboxylases and biotin-carboxyl-carrier proteins, Jager, W. et al, Jan. 16, 1997.
GenBank Accession No. U43535 for A *Corybacterium glutamicum* gene conferring multidrug resistance in the heterogous host *Escherichia coli*, Jager, W. et al, Apr. 9, 1997.
GenBank Accession No. U53536 for A *Corybacterium glutamicum*, Jaeger, W. et al, Mar. 13, 1997.
GenBank Accession No. U53587 for Utilization of IS1207 for insertional mutagenesis in *Corynebacterium*, Bonamy, C. et al, May 6, 1996.
GenBank Accession No. U89648 for *Corynebacterium glutamicum*, Kim, S.Y. et al, Mar. 30, 1999.
GenBank Accession No. X04960 for complete nucleotide and deduced amino acid sequences of the *Brevibacterium lactofermentum* tryptophan operon, Matsui, K. et al, Apr. 18, 2005.
GenBank Accession No. X07563 for Nucleotide sequence of the lysA gene of *Corynebacterium glutamicum* and possible mechanisms for modulation of its expression, Yeh, P. et al, Apr. 18, 2005.
GenBank Accession No. X14234 for The Phosphoenolpyruvate carboxylase gene of *Corynebacterium glutamicum*: molecular cloning, nucleotide sequence, and expression, Eikmanns, B.J. et al, Apr. 18, 2005.
GenBank Accession No. X17313 for Molecular cloning, nucleotide sequence and fine-structural analysis of teh *Corynebacterium glutamicum* fda gene: structural comparison of C. glutamicum fructose-1, 6-biphosphate aldolase to class I and Class II aldolase, von der Osten, C.H. et al, Apr. 18, 2005.
GenBank Accession No. X53993 for Nucleotide sequence of the dapA gene from *Corynebacterium glutamicum*, Bonnassle, S. et al, Apr. 18, 2005.
GenBank Accession No. X54223 for DNA sequence homology between att B-related sites of *corynebacterium diphtheriae*, *Corynebacterium ulcerans*, *Corynebacterium glutamicum*, and the attP site of lambda-corynephage, Cianciotto, N. et al, Dec. 17, 1992.
GenBank Accession No. X54740 for Nucleotide sequence and organization of the upstream region of the *Corynebacterium glutamicum* lysA gene, Marcel, T. et al, Apr. 18, 2005.
GenBank Accession No. X55994 for Nucleotide sequence oh the *Corynebacterium glutamicum* trpE gene, Heery, D.M. et al, Apr. 18, 2005.
GenBank Accession No. X56037 for The molecular structure of the *Corynebacterium glutamicum* threonine synthase gene, Han, K.S. et al, Apr. 18, 2005.
GenBank Accession No. X56075 for DNA sequence homology between att B-related sites of *corynebacterium diphtheriae*, *Corynebacterium ulcerans*, *Corynebacterium glutamicum*, adn the attP site of *lambda-corynephage*, Cianciotto, N. et al, Dec. 17, 1992.
GenBank Accession No. X57226 for Aspartokinase genes lysC alpha and lysC beta overlap and are adjacent to the aspartate beta-semialdehyde dehydrogenase gene asd *Corynebacterium glutamicum*, Kalinowski, J. et al, Apr. 18, 2005.
GenBank Accession No. X59403 for Indentification, sequence analysis, and expression of a *Corynebacterium glutamicum* gene cluster encoding the three glycolytic enzymes glyceraldehyde-3-phosphate dehydrogenase, 3-dephosphoglycerate kinase, and triosephosphate isomerase, Eikmanns, B.J. et al, Apr. 18, 2005.
GenBank Accession No. X59404, Bormann, E.R. et al, "Molecular analysis of the *Corynebacterium glutamicum* gbh gene encoding glutamate dehydrogenase," *Mol. Microbiol.*, vol. 6(3):317-326 (1992), Apr. 18, 2005.
GenBank Accession No. X60312 for Molecular analysis of the *Coynebacterium glutamicum* lysI gene involved in lysine uptake, Seep-Feldhaus, A.H. et al, Jan. 30, 1992.
GenBank Accession No. X66078 for Cloning and nucleotide sequence of the csp1 gene encoding PS1, one of the two major secreted proteins of *Corynebacterium glutamicum*; the deduced N-terminal region of PS1 similar to the Mycobacterium antigen 85 complex, Joliff, G. et al, Jun. 30, 1993.
GenBank Accession No. X66112, Eikmanns, B.J. et al, "Nucleotide sequence, expression and transcriptional analysis of the *Corynebacterium glutamicum* gltA gene encoding citrate synthase," *Microbiology*, vol. 140(pt. 8):1817-1828 (1994), Apr. 18, 2005.
GenBank Accession No. X67737 for *Corynebacterium glutamicum*, Eikmanns, B.J. et al, Apr. 18, 2005.
GenBank Accession No. X69103 for Characterization of the cspB gene encoding PS2, an ordered surface-layer protein in *Corynebacterium glutamicum*, Peyret, J.L. et al, Seo. 9, 2004.
GenBank Accession No. X69104 for Identification of IS1206, a *Corynebacterium glutamicum* IS3-related insertion sequence and phylogenetic analysis, Bonamy, C. et al, Sep. 9, 2004.
GenBank Accession No. X70584 for In vivo comparison of zidovudine resistance mutations in blood and CSF of HIV-1-infected patients, Wildemann, B. et al, Aug. 6, 1995.
GenBank Accession No. X70959 for Leucine synthesis in *Corynebacterium glutamicum*: enzyme activities, structure of leuA, and effect of leuA inactivation on lysine synthesis, Patek, M. et al, Sep. 9, 2004.
GenBank Accession No. X71489 for Cloning, sequencing analysis, expression, and inactivation of the *Corynebacterium glutamicum* icd gene encoding isocitrate dehydrogenase and biochemical characterization of the enzyme, Eikmanns, B.J. et al, Apr. 18, 2005.
GenBank Accession No. X72855, Guyonvarch, A. et al "Glutamate dehydrogenase (gdhA) gene." Apr. 18, 2005.
GenBank Accession No. X75083 for A sequence from a tryptophan-hyperproducing strain of *Corynebacterium glutamicum* encoding resistance to 5-methyltryptophan, Heery, D.M. et al, Aug. 18, 1994.
GenBank Accession No. X75085 for Construction and characterization of recA mutant strains of *Corynebacterium glutamicum* and *Brevibacterium lactofermentum*, Fitzpatrick, R. et al, Apr. 18, 2005.
GenBank Accession No. X75504 for Characterization of the isocitrate lyase gene from *Corynebacterium glutamicum* and biochemical analysis of the enzyme, Reinscheid, D.L. et al, Apr. 18, 2005.
GenBank Accession No. X76875 for Phylogenetic relationships of Bacteria based on comparative sequence analysis of enlongation factor Tu and ATP-synthase beta-subunit genes, Ludwig, W. et al, Oct. 27, 1994.
GenBank Accession No. X77034 for Phylogenetic relationships of Bacteria based on comparative sequence analysis of enlongation factor Tu and ATP-synthase beta-subunit genes, Ludwig, W. et al, Apr. 18, 2005.
GenBank Accession No. X77384 for Nucleotide sequence of a recA gene from *Corynebacterium glutamicum*, Billman-Jacobe, H. et al, Apr. 18, 2005.
GenBank Accession No. X78491 for Malate synthase from *Corynebacterium glutamicum*: sequence analysis of the gene and biochemical characterization of the enzyme, Reinscheid, D.J. et al, Apr. 18, 2005.

GenBank Accession No. X80629 for Phylogenetic analysis of the genera Rhodococcus and *Norcardia* and evidence for the evolutionary origin of the genus Norcardia from within the radiation of Rhodococcus species, Rainey, F.A. et al, Apr. 1, 2004.

GenBank Accession No. X81191 for Structure of the gluABCD cluster encoding the glutamate uptake system of *Corynebacterium glutamicum*, Kronemeyer, W. et al, Apr. 18, 2005.

GenBank Accession No. X81379, Wehrmann, A. et al, "Analysis of different DNA fragments of *Corynebacterium glutamicum* complementing dapE of *Esherichia coli*,"*Microbiology*, vol. 140(pt. 12):3349-3356 (1994), Feb. 25, 2003.

GenBank Accession No. X82061 for Phylogeny of the genus *Corynebacterium* deduced from analysis of small-subunit ribosomal DNA sequences, Ruimy, R. et al, Nov. 10, 1995.

GenBank Accession No. X82928 for Multicopy suppression by asd gene and osomotic stress-dependent complementation by heterologous proA mutants, Serebrijski, I. et al, Apr. 18, 2005.

GenBank Accession No. X82929 for Multicopy suppression by asd gene and osomotic stress-dependent complementation by heterologous proA mutants, Serebrijski, I. et al, Apr. 18, 2005.

GenBank Accession No. X84257 for Phylogenetic analysis of the genus *Corynebacterium* based on 16S rRNA gene sequences, Pascual, C. et al, Jan. 9, 2004.

GenBank Accession No. X85965, Wehrmann, A. et al, "Functional analysis of sequences adjacent to dapE of *Corynebacterium glutamicum* reveals the presence of aroP, which encodes the aromatic amino acid transporter," *J. Bacteriol.*, vol. 177(20):5991-5993 (1995), Nov. 30, 1997.

GenBank Accession No. X86157, Sakanyan, V. et al, "Genes and enzymes of the acetyl cycle of arginine biosynthesis in *Corynebacterium glutamicum*: enzyme evolution in the early steps of the arginine pathway," *Microbiology*, vol. 142(Pt. 1):99-108 (1996), Apr. 18, 2005.

GenBank Accession No. X86780 for The biosynthetic gene cluster for the polyketide immunosuppressant rapamycin, Schwecke, T. et al, Apr. 18, 2005.

GenBank Accession No. X89084 for Cloning, sequence analysis, expression and inactivation of the *Corynebacterium glutamicum* pta-ack operon encoding phosphotransacetylase and acetate kinase, Reinscheld, D.J. et al, Apr. 18, 2005.

GenBank Accession No. X89850 for Genetic characterization of site-specific integration functions of phi AAU2 infecting 'Arthrobacter aureus' C70, Le Marrec, C. et al, Aug. 8, 1996.

GenBank Accession No. X90356 for Promoters from *Corynebacterium glutamicum*: cloning, molecular analysis and search for a consensus motif, Patek, M. et al, Nov. 4, 1996.

GenBank Accession No. X90357 for Promoters from *Corynebacterium glutamicum*: cloning, molecular analysis and search for a consensus motif, Patek, M. et al, Nov. 4, 1996.

GenBank Accession No. X90358 for Promoters from *Corynebacterium glutamicum*: cloning, molecular analysis and search for a consensus motif, Patek, M. et al, Nov. 4, 1996.

GenBank Accession No. X90359 for Promoters from *Corynebacterium glutamicum*: cloning, molecular analysis and search for a consensus motif, Patek, M. et al, Nov. 4, 1996.

GenBank Accession No. X90360 for Promoters from *Corynebacterium glutamicum*: cloning, molecular analysis and search for a consensus motif, Patek, M. et al, Nov. 4, 1996.

GenBank Accession No. X90361 for Promoters from *Corynebacterium glutamicum*: cloning, molecular analysis and search for a consensus motif, Patek, M. et al, Nov. 4, 1996.

GenBank Accession No. X90362 for Promoters from *Corynebacterium glutamicum*: cloning, molecular analysis and search for a consensus motif, Patek, M. et al, Nov. 4, 1996.

GenBank Accession No. X90363 for Promoters from *Corynebacterium glutamicum*: cloning, molecular analysis and search for a consensus motif, Patek, M. et al, Nov. 4, 1996.

GenBank Accession No. X90364 for Promoters from *Corynebacterium glutamicum*: cloning, molecular analysis and search for a consensus motif, Patek, M. et al, Nov. 4, 1996.

GenBank Accession No. X90365 for Promoters from *Corynebacterium glutamicum*: cloning, molecular analysis and search for a consensus motif, Patek, M. et al, Nov. 4, 1996.

GenBank Accession No. X90366 for Promoters from *Corynebacterium glutamicum*: cloning, molecular analysis and search for a consensus motif, Patek, M. et al, Nov. 4, 1996.

GenBank Accession No. X90367 for Promoters from *Corynebacterium glutamicum*: cloning, molecular analysis and search for a consensus motif, Patek, M. et al, Nov. 4, 1996.

GenBank Accession No. X90368 for Promoters from *Corynebacterium glutamicum*: cloning, molecular analysis and search for a consensus motif, Patek, M. et al, Nov. 4, 1996.

GenBank Accession No. X93513, Siewe, R.M. et al, "Functional and genetic characterization of the (methyl)ammonium uptake carrier of *Corynebacterium glutamicum*,"*J. Biol. Chem.*, vol. 271(10):5398-5403 (1996), May 29, 1996.

GenBank Accession No. X93514 for Isolation, characterization, and expression of the *Corynebacterium glutamicum* betP gene, encoding the transport system for the compatible solute glycine betaine, Peter, H. et al, Sep. 8, 1997.

GenBank Accession No. X95649 for Identification and transcriptional analysis of the dapB-ORF2-dapA-ORF4 operon of *Corynebacterium glutamicum*, encoding two enzymes involved in L-lysine synthesis, Patek, M. et al, Dec. 21, 2000.

GenBank Accession No. X96471 for A new type of transporter with a new type of cellular function: L-lysine export from *Corynebacterium glutamicum*, Vrljic, M. et al, Apr. 18, 2005.

GenBank Accession No. X96580, Sahm, H. et al, "D-Pantothenate synthesis in *Corynebacterium glutamicum* and use of panBC and genes encoding L-valine synthesis for D-pantothenate overproduction," *Appl. Environ. Microbiol.*, vol. 65(5):1973-1979 (1999), Apr. 18, 2005.

GenBank Accession No. X96962 for Utilisation of IS1207 for insertional mutagenesis in *Corynebacterium*, Bonamy, C. et al, Jul. 7, 2002.

GenBank Accession No. X99289 for Cloning, sequencing and expression of the gene encoding elongation factor P in the amino-acid producer *Brevibacterium lactofermentum* (*Corynebacterium glutamicum* ATCC 13869), Ramos, A. et al, Sep.9, 2004.

GenBank Accession No. Y00140 for Nucleotide sequence of the homoserine kinase (thr B) gene of *Brevibacterium lactofermentum*, Mateos, L.M. et al, Sep. 12, 1993.

GenBank Accession No. Y00151 for Nucleotide sequence of the meso-diaminopimelate D-dehydrogenase gene from *Corynebacterium glutamicum*, Ishino, S. et al, Sep. 12, 1993.

GenBank Accession No. Y00476 for Nucleotide sequence of the homoserine dehydrogenase (thr A) gene of *Brevibacterium lactofermentum*, Mateos, L.M. et al, May 5, 1993.

GenBank Accession No. Y00546 for Nucleotide sequence and fine structural analysis of the *Corynebacterium glutamicum* hom-thrB operon, Peoples, O.P. et al, Sep. 12, 1993.

GenBank Accession No. Y08964 for Identification, characterization, and chromosomal organization of the ftsZ gene for *Brevibacterium lactofermentum*, Honrubia, M.P. et al, Apr. 18, 2005.

GenBank Accession No. Y09163 for Isolation of the putP gene of *Corynebacterium glutamcium* and characterization of a low-affinity uptake system for compatible solutes, Peter, H. et al, Sep. 8, 1997.

GenBank Accession No. Y09548 for Pyruvate carboxylase from *Corynebacterium glutamicum*: characterization, expression and inactivation of the pyc gene, Peters-Wendisch, P.G. et al, Apr. 18, 2005.

GenBank Accession No. Y09578 for Analysis of the leuB gene from *Corynebacterium glutamicum*, Patek, M. et al, Apr. 18, 2005.

GenBank Accession No. Y12472 for Site-specific integration of corynephage phi16: the construction of an Integration vector, Moreau, S. et al, Mar. 5, 1999.

GenBank Accession No. Y12537 for *Corynebacterium glutamium* is equipped with four secondary carriers for compatible solutes: identification, sequencing, and characterization of the proline/glycine betaine carrier, EctP, Peter, H. et al, Nov. 17, 1998.

GenBank Accession No. Y13221 for Isolation of the *Corynebacterium glutamicum* glnA gene encoding glutamine synthetase I, Jakoby, M. et al, Aug. 28, 1997.

GenBank Accession No. Y13627 for Identification of novel intergenic repetitive units in a mycobacterial two-component system operon, Supply, P. et al, Apr. 18, 2005.

GenBank Accession No. Y16642 for *Corynebacterium glutamicum*, Schwinde, J. et al, Apr. 18, 2005.

GenBank Accession No. Y18059 for Analysis of the integration functions of phi304L: an integrase module among corynephages, Moreau, S. et al, Sep. 29, 1999.

GenBank Accession No. Z21501 A gene encoding arginyl-tRNA synthetase is located in the upstream region of the lysA gene in *Brevibacterium lactofermentum*: regulation of argS-lysA cluster expression by arginine, Oguiza, J.A. et al, Apr. 18, 2005.

GenBank Accession No. Z21502 for cluster of three genes (dapA, orf2, and dapB) *Brevibacterium lactofermentum* encodes dihydrodipicolinate synthase, dihydrodipicolinate reductase, and a third polypeptide of known function, Pisabarro, A. et al, Aug. 16, 1993.

GenBank Accession No. Z29563 for Analysis and expression of the thrC gene of *Brevibacterium lactofermentum* and characterization of the encoded theronine synthase, Malumbres, M. et al, Apr. 18, 2005.

GenBank Accession No. Z46753 for Phylogeny of *Corynebacterium glutamicum*, Chun, J. et al, Nov. 21, 1994.

GenBank Accession No. Z49822 Multiple sigma factor genes in *Brevibacterium lactofermentum*: characterization of sigA and sigB, Oguiza, J.A. et al, Apr. 18, 2005.

GenBank Accession No. Z49823 for The galE gene encoding the UDP-galactose 4-epimerase of *Brevibacterium lactofermentum* is coupled transcriptionally to the dmdR gene, Oguiza, J.A. et al, Apr. 18, 2005.

GenBank Accession No. Z49824 for Multiple sigma factor genes in *Brevibacterium lactofermentum*: characterization of sigA and sigB, Oguiza, J.A. et al, Apr. 18, 2005.

GenBank Accession No. Z66534 for Cloning and characterization of an IS-like element present in the genome of *Brevibacterium lactofermentum* ATCC 13869, Correia, A. et al, Jul, 7, 2002.

GenBank Accession No. Z77162 for Deciphering the biology of *Mycobacterium tuberculosis* from the complete genome sequence, Cole, S.T. et al, Sep. 2, 2002.

GenBank Accession No. Z80226 for Deciphering the biology of *Mycobacterium tuberculosis* from complete genome sequence, Cole, S.T. et al, Sep. 2, 2002.

GenBank Accession No. Z81368, Cole, S.T. et al, "Deciphering the biology of *Mycobacterium tuberculosis* from the complete genome sequence," *Nature*, vol. 393(6685):537-544 (1998), Sep. 2, 2002.

GenBank Accession No. Z83866 for Deciphering the biology of *Mycobacterium tuberculosis* from the complete genome sequence, Cole, S.T. et al, Sep. 2, 2002.

GenBank Accession No. Z98209, Cole, S.T. et al, "Deciphering the biology of *Mycobacterium tuberculosis* from the complete genome sequence," *Nature*, vol. 393(6685):537-544 (1998), Aug. 3, 2001.

Cole et al., "Deciphering the biology of *Mycobacterium tuberculosis* from the complete genome sequence," *Nature*. Jun. 11, 1998;393(6685):537-544.

Park SD, et al., "Isolation and analysis of metA, a methionine biosynthetic gene encoding homoserine acetyltransferase in *corynebacterium glutamicum*," *Mol Cells*. Jun. 30, 1998;8(3):286-94.

* cited by examiner

CORYNEBACTERIUM GLUTAMICUM GENES ENCODING DIAMINOPIMELATE EPIMERASE

RELATED APPLICATIONS

The present application claims priority to prior filed U.S. Provisional Patent Application Ser. No. 60/141,031, filed Jun. 25, 1999, U.S. Provisional Patent Application Ser. No. 60/142,101, filed Jul. 2, 1999, U.S. Provisional Patent Application Ser. No. 60/148,613, filed Aug. 12, 1999, and also to U.S. Provisional Patent Application Ser. No. 60/187,970, filed Mar. 9, 2000. The present application also claims priority to prior filed German Patent Application No. 19930476.9, filed Jul. 1, 1999, German Patent Application No. 19931415.2, filed Jul. 8, 1999, German Patent Application No. 19931418.7, filed Jul. 8, 1999, German Patent Application No. 19931419.5, filed Jul. 8, 1999, German Patent Application No. 19931420.9, filed Jul. 8, 1999, German Patent Application No. 19931424.1, filed Jul. 8, 1999, German Patent Application No. 19931428.4, filed Jul. 8, 1999, German Patent Application No. 19931434.9, filed Jul. 8, 1999, German Patent Application No. 19931435.7, filed Jul. 8, 1999, German Patent Application No. 19931443.8, filed Jul. 8, 1999, German Patent Application No. 19931453.5, filed Jul. 8, 1999, German Patent Application No. 19931457.8, filed Jul. 8, 1999, German Patent Application No. 19931465.9, filed Jul. 8, 1999, German Patent Application No. 19931478.0, filed Jul. 8, 1999, German Patent Application No. 19931510.8, filed Jul. 8, 1999, German Patent Application No. 19931541.8, filed Jul. 8, 1999, German Patent Application No. 19931573.6, filed Jul. 8, 1999, German Patent Application No. 19931592.2, filed Jul. 8, 1999, German Patent Application No. 19931632.5, filed Jul. 8, 1999, German Patent Application No. 19931634.1, filed Jul. 8, 1999, German Patent Application No. 19931636.8, filed Jul. 8, 1999, German Patent Application No. 19932125.6, filed Jul. 9, 1999, German Patent Application No. 19932126.4, filed Jul. 9, 1999, German Patent Application No. 19932130.2, filed Jul. 9, 1999, German Patent Application No. 19932186.8, filed Jul. 9, 1999, German Patent Application No. 19932206.6, filed Jul. 9, 1999, German Patent Application No. 19932227.9, filed Jul. 9, 1999, German Patent Application No. 19932228.7, filed Jul. 9, 1999, German Patent Application No. 19932229.5, filed Jul. 9, 1999, German Patent Application No. 19932230.9, filed Jul. 9, 1999, German Patent Application No. 19932922.2, filed Jul. 14, 1999, German Patent Application No. 19932926.5, filed Jul. 14, 1999, German Patent Application No. 19932928.1, filed Jul. 14, 1999, German Patent Application No. 19933004.2, filed Jul. 14, 1999, German Patent Application No. 19933005.0, filed Jul. 14, 1999, German Patent Application No. 19933006.9, filed Jul. 14, 1999, German Patent Application No. 19940764.9, filed Aug. 27, 1999, German Patent Application No. 19940765.7, filed Aug. 27, 1999, German Patent Application No. 19940766.5, filed Aug. 27, 1999, German Patent Application No. 19940832.7, filed Aug. 27, 1999, German Patent Application No. 19941378.9, filed Aug. 31, 1999, German Patent Application No. 19941379.7, filed Aug. 31, 1999, German Patent Application No. 19941380.0, filed Aug. 31, 1999, German Patent Application No. 19941394.0, filed Aug. 31, 1999, German Patent Application No. 19941396.7, filed Aug. 31, 1999, German Patent Application No. 19942076.9, filed Sep. 3, 1999, German Patent Application No. 19942077.7, filed Sep. 3, 1999, German Patent Application No. 19942079.3, filed Sep. 3, 1999, German Patent Application No. 19942086.6, filed Sep. 3, 1999, German Patent Application No. 19942087.4, filed Sep. 3, 1999, German Patent Application No. 19942088.2, filed Sep. 3, 1999, German Patent Application No. 19942095.5, filed Sep. 3, 1999, German Patent Application No. 19942124.2, filed Sep. 3, 1999, and German Patent Application No. 19942129.3, filed Sep. 3, 1999. The entire contents of all of the aforementioned applications are hereby expressly incorporated herein by this reference.

Incorporation of Material Submitted on Compact Discs

This application incorporates herein by reference the material contained on the compact discs submitted herewith as part of this application. Specifically, the file "Seqlist" (3.85 MB) contained on each of Copy 1 and Copy 2 of the Sequence Listing is hereby incorporated herein by reference. This file was created on Feb. 4, 2005.

BACKGROUND OF THE INVENTION

Certain products and by-products of naturally-occurring metabolic processes in cells have utility in a wide array of industries, including the food, feed, cosmetics, and pharmaceutical industries. These molecules, collectively termed 'fine chemicals', include organic acids, both proteinogenic and non-proteinogenic amino acids, nucleotides and nucleosides, lipids and fatty acids, diols, carbohydrates, aromatic compounds, vitamins and cofactors, and enzymes. Their production is most conveniently performed through large-scale culture of bacteria developed to produce and secrete large quantities of a particular desired molecule. One particularly useful organism for this purpose is *Corynebacterium glutamicum*, a gram positive, nonpathogenic bacterium. Through strain selection, a number of mutant strains have been developed which produce an array of desirable compounds. However, selection of strains improved for the production of a particular molecule is a time-consuming and difficult process.

SUMMARY OF THE INVENTION

The invention provides novel bacterial nucleic acid molecules which have a variety of uses. These uses include the identification of microorganisms which can be used to produce fine chemicals, the modulation of fine chemical production in *C. glutamicum* or related bacteria, the typing or identification of *C. glutamicum* or related bacteria, as reference points for mapping the *C. glutamicum* genome, and as markers for transformation. These novel nucleic acid molecules encode proteins, referred to herein as metabolic pathway (MP) proteins.

*C. glutamicum* is a gram positive, aerobic bacterium which is commonly used in industry for the large-scale production of a variety of fine chemicals, and also for the degradation of hydrocarbons (such as in petroleum spills) and for the oxidation of terpenoids. The MP nucleic acid molecules of the invention, therefore, can be used to identify microorganisms which can be used to produce fine chemicals, e.g., by fermentation processes. Modulation of the expression of the MP nucleic acids of the invention, or modification of the sequence of the MP nucleic acid molecules of the invention, can be used to modulate the production of one or more fine chemicals from a microorganism (e.g., to improve the yield or production of one or more fine chemicals from a *Corynebacterium* or *Brevibacterium* species).

The MP nucleic acids of the invention may also be used to identify an organism as being *Corynebacterium glutamicum* or a close relative thereof, or to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to species pathogenic in humans, such as *Corynebacterium diphtheriae* (the causative agent of diphtheria); the detection of such organisms is of significant clinical relevance.

The MP nucleic acid molecules of the invention may also serve as reference points for mapping of the *C. glutamicum* genome, or of genomes of related organisms. Similarly, these molecules, or variants or portions thereof, may serve as markers for genetically engineered *Corynebacterium* or *Brevibacterium* species. The MP proteins encoded by the novel nucleic acid molecules of the invention are capable of, for example, performing an enzymatic step involved in the metabolism of certain fine chemicals, including amino acids, vitamins, cofactors, nutraceuticals, nucleotides, nucleosides, and trehalose. Given the availability of cloning vectors for use in *Corynebacterium glutamicum*, such as those disclosed in Sinskey et al., U.S. Pat. No. 4,649,119, and techniques for genetic manipulation of *C. glutamicum* and the related *Brevibacterium* species (e.g., *lactofermentum*) (Yoshihama et al., *J. Bacteriol.* 162: 591-597 (1985); Katsumata et al., *J. Bacteriol.* 159: 306-311 (1984); and Santamaria et al., *J. Gen. Microbiol.* 130: 2237-2246 (1984)), the nucleic acid molecules of the invention may be utilized in the genetic engineering of this organism to make it a better or more efficient producer of one or more fine chemicals.

This improved production or efficiency of production of a fine chemical may be due to a direct effect of manipulation of a gene of the invention, or it may be due to an indirect effect of such manipulation. Specifically, alterations in *C. glutamicum* metabolic pathways for amino acids, vitamins, cofactors, nucleotides, and trehalose may have a direct impact on the overall production of one or more of these desired compounds from this organism. For example, optimizing the activity of a lysine biosynthetic pathway protein or decreasing the activity of a lysine degradative pathway protein may result in an increase in the yield or efficiency of production of lysine from such an engineered organism. Alterations in the proteins involved in these metabolic pathways may also have an indirect impact on the production or efficiency of production of a desired fine chemical. For example, a reaction which is in competition for an intermediate necessary for the production of a desired molecule may be eliminated, or a pathway necessary for the production of a particular intermediate for a desired compound may be optimized. Further, modulations in the biosynthesis or degradation of, for example, an amino acid, a vitamin, or a nucleotide may increase the overall ability of the microorganism to rapidly grow and divide, thus increasing the number and/or production capacities of the microorganism in culture and thereby increasing the possible yield of the desired fine chemical.

The nucleic acid and protein molecules of the invention may be utilized to directly improve the production or efficiency of production of one or more desired fine chemicals from *Corynebacterium glutamicum*. Using recombinant genetic techniques well known in the art, one or more of the biosynthetic or degradative enzymes of the invention for amino acids, vitamins, cofactors, nutraceuticals, nucleotides, nucleosides, or trehalose may be manipulated such that its function is modulated. For example, a biosynthetic enzyme may be improved in efficiency, or its allosteric control region destroyed such that feedback inhibition of production of the compound is prevented. Similarly, a degradative enzyme may be deleted or modified by substitution, deletion, or addition such that its degradative activity is lessened for the desired compound without impairing the viability of the cell. In each case, the overall yield or rate of production of the desired fine chemical may be increased.

It is also possible that such alterations in the protein and nucleotide molecules of the invention may improve the production of other fine chemicals besides the amino acids, vitamins, cofactors, nutraceuticals, nucleotides, nucleosides, and trehalose through indirect mechanisms. Metabolism of any one compound is necessarily intertwined with other biosynthetic and degradative pathways within the cell, and necessary cofactors, intermediates, or substrates in one pathway are likely supplied or limited by another such pathway. Therefore, by modulating the activity of one or more of the proteins of the invention, the production or efficiency of activity of another fine chemical biosynthetic or degradative pathway may be impacted. For example, amino acids serve as the structural units of all proteins, yet may be present intracellularly in levels which are limiting for protein synthesis; therefore, by increasing the efficiency of production or the yields of one or more amino acids within the cell, proteins, such as biosynthetic or degradative proteins, may be more readily synthesized. Likewise, an alteration in a metabolic pathway enzyme such that a particular side reaction becomes more or less favored may result in the over- or under-production of one or more compounds which are utilized as intermediates or substrates for the production of a desired fine chemical.

This invention provides novel nucleic acid molecules which encode proteins, referred to herein as metabolic pathway proteins (MP), which are capable of, for example, performing an enzymatic step involved in the metabolism of molecules important for the normal functioning of cells, such as amino acids, vitamins, cofactors, nucleotides and nucleosides, or trehalose. Nucleic acid molecules encoding an MP protein are referred to herein as MP nucleic acid molecules. In a preferred embodiment, the MP protein performs an enzymatic step related to the metabolism of one or more of the following: amino acids, vitamins, cofactors, nutraceuticals, nucleotides, nucleosides, and trehalose. Examples of such proteins include those encoded by the genes set forth in Table 1.

Accordingly, one aspect of the invention pertains to isolated nucleic acid molecules (e.g., cDNAs, DNAs, or RNAs) comprising a nucleotide sequence encoding an MP protein or biologically active portions thereof, as well as nucleic acid fragments suitable as primers or hybridization probes for the detection or amplification of MP-encoding nucleic acid (e.g., DNA or mRNA). In particularly preferred embodiments, the isolated nucleic acid molecule comprises one of the nucleotide sequences set forth in Appendix A or the coding region or a complement thereof of one of these nucleotide sequences. In other particularly preferred embodiments, the isolated nucleic acid molecule of the invention comprises a nucleotide sequence which hybridizes to or is at least about 50%, preferably at least about 60%, more preferably at least about 70%, 80% or 90%, and even more preferably at least about 95%, 96%, 97%, 98%, 99% or more homologous to a nucleotide sequence set forth in Appendix A, or a portion thereof. In other preferred embodiments, the isolated nucleic acid molecule encodes one of the amino acid sequences set forth in Appendix B. The preferred MP proteins of the present invention also preferably possess at least one of the MP activities described herein.

In another embodiment, the isolated nucleic acid molecule encodes a protein or portion thereof wherein the protein or portion thereof includes an amino acid sequence which is sufficiently homologous to an amino acid sequence of Appendix B, e.g., sufficiently homologous to an amino acid sequence of Appendix B such that the protein or portion thereof maintains an MP activity. Preferably, the protein or portion thereof encoded by the nucleic acid molecule maintains the ability to perform an enzymatic reaction in a amino acid, vitamin, cofactor, nutraceutical, nucleotide, nucleoside, or trehalose metabolic pathway. In one embodiment, the protein encoded by the nucleic acid molecule is at least about 50%, preferably at least about 60%, and more preferably at least about 70%, 80%, or 90% and most preferably at least about 95%, 96%, 97%, 98%, or 99% or more homologous to an amino acid sequence of Appendix B (e.g., an entire amino acid sequence selected from those sequences set forth in Appendix B). In another preferred embodiment, the protein is a full length *C. glutamicum* protein which is substantially homologous to an entire amino acid sequence of Appendix B (encoded by an open reading frame shown in Appendix A).

In another preferred embodiment, the isolated nucleic acid molecule is derived from *C. glutamicum* and encodes a protein (e.g., an MP fusion protein) which includes a biologically active domain which is at least about 50% or more homologous to one of the amino acid sequences of Appendix B and is able to catalyze a reaction in a metabolic pathway for an amino acid, vitamin, cofactor, nutraceutical, nucleotide, nucleoside, or trehalose, or one or more of the activities set forth in Table 1, and which also includes heterologous nucleic acid sequences encoding a heterologous polypeptide or regulatory regions.

In another embodiment, the isolated nucleic acid molecule is at least 15 nucleotides in length and hybridizes under stringent conditions to a nucleic acid molecule comprising a nucleotide sequence of Appendix A. Preferably, the isolated nucleic acid molecule corresponds to a naturally-occurring nucleic acid molecule. More preferably, the isolated nucleic acid encodes a naturally-occurring *C. glutamicum* MP protein, or a biologically active portion thereof.

Another aspect of the invention pertains to vectors, e.g., recombinant expression vectors, containing the nucleic acid molecules of the invention, and host cells into which such vectors have been introduced. In one embodiment, such a host cell is used to produce an MP protein by culturing the host cell in a suitable medium. The MP protein can be then isolated from the medium or the host cell.

Yet another aspect of the invention pertains to a genetically altered microorganism in which an MP gene has been introduced or altered. In one embodiment, the genome of the microorganism has been altered by introduction of a nucleic acid molecule of the invention encoding wild-type or mutated MP sequence as a transgene. In another embodiment, an endogenous MP gene within the genome of the microorganism has been altered, e.g., functionally disrupted, by homologous recombination with an altered MP gene. In another embodiment, an endogenous or introduced MP gene in a microorganism has been altered by one or more point mutations, deletions, or inversions, but still encodes a functional MP protein. In still another embodiment, one or more of the regulatory regions (e.g., a promoter, repressor, or inducer) of an MP gene in a microorganism has been altered (e.g., by deletion, truncation, inversion, or point mutation) such that the expression of the MP gene is modulated. In a preferred embodiment, the microorganism belongs to the genus *Corynebacterium* or *Brevibacterium*, with *Corynebacterium glutamicum* being particularly preferred. In a preferred embodiment, the microorganism is also utilized for the production of a desired compound, such as an amino acid, with lysine being particularly preferred.

In another aspect, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject.

Still another aspect of the invention pertains to an isolated MP protein or a portion, e.g., a biologically active portion, thereof. In a preferred embodiment, the isolated MP protein or portion thereof can catalyze an enzymatic reaction involved in one or more pathways for the metabolism of an amino acid, a vitamin, a cofactor, a nutraceutical, a nucleotide, a nucleoside, or trehalose. In another preferred embodiment, the isolated MP protein or portion thereof is sufficiently homologous to an amino acid sequence of Appendix B such that the protein or portion thereof maintains the ability to catalyze an enzymatic reaction involved in one or more pathways for the metabolism of an amino acid, a vitamin, a cofactor, a nutraceutical, a nucleotide, a nucleoside, or trehalose.

The invention also provides an isolated preparation of an MP protein. In preferred embodiments, the MP protein comprises an amino acid sequence of Appendix B. In another preferred embodiment, the invention pertains to an isolated full length protein which is substantially homologous to an entire amino acid sequence of Appendix B (encoded by an open reading frame set forth in Appendix A). In yet another embodiment, the protein is at least about 50%, preferably at least about 60%, and more preferably at least about 70%, 80%, or 90%, and most preferably at least about 95%, 96%, 97%, 98%, or 99% or more homologous to an entire amino acid sequence of Appendix B. In other embodiments, the isolated MP protein comprises an amino acid sequence which is at least about 50% or more homologous to one of the amino acid sequences of Appendix B and is able to catalyze an enzymatic reaction in an amino acid, vitamin, cofactor, nutraceutical, nucleotide, nucleoside, or trehalose metabolic pathway, or has one or more of the activities set forth in Table 1.

Alternatively, the isolated MP protein can comprise an amino acid sequence which is encoded by a nucleotide sequence which hybridizes, e.g., hybridizes under stringent conditions, or is at least about 50%, preferably at least about 60%, more preferably at least about 70%, 80%, or 90%, and even more preferably at least about 95%, 96%, 97%, 98,%, or 99% or more homologous, to a nucleotide sequence of Appendix B. It is also preferred that the preferred forms of MP proteins also have one or more of the MP bioactivities described herein.

The MP polypeptide, or a biologically active portion thereof, can be operatively linked to a non-MP polypeptide to form a fusion protein. In preferred embodiments, this fusion protein has an activity which differs from that of the MP protein alone. In other preferred embodiments, this fusion protein, when introduced into a *C. glutamicum* pathway for the metabolism of an amino acid, vitamin, cofactor, nutraceutical, results in increased yields and/or efficiency of production of a desired fine chemical from *C. glutamicum*. In particularly preferred embodiments, integration of this fusion protein into an amino acid, vitamin, cofactor, nutraceutical, nucleotide, nucleoside, or trehalose metabolic pathway of a host cell modulates production of a desired compound from the cell.

In another aspect, the invention provides methods for screening molecules which modulate the activity of an MP protein, either by interacting with the protein itself or a substrate or binding partner of the MP protein, or by modulating the transcription or translation of an MP nucleic acid molecule of the invention.

Another aspect of the invention pertains to a method for producing a fine chemical. This method involves the culturing of a cell containing a vector directing the expression of an MP nucleic acid molecule of the invention, such that a fine chemical is produced. In a preferred embodiment, this method further includes the step of obtaining a cell containing such a vector, in which a cell is transfected with a vector directing the expression of an MP nucleic acid. In another preferred embodiment, this method further includes the step of recovering the fine chemical from the culture. In a particularly preferred embodiment, the cell is from the genus *Corynebacterium* or *Brevibacterium*, or is selected from those strains set forth in Table 3.

Another aspect of the invention pertains to methods for modulating production of a molecule from a microorganism. Such methods include contacting the cell with an agent which modulates MP protein activity or MP nucleic acid expression such that a cell associated activity is altered relative to this same activity in the absence of the agent. In a preferred embodiment, the cell is modulated for one or more *C. glutamicum* amino acid, vitamin, cofactor, nutraceutical, nucleotide, nucleoside, or trehalose metabolic pathways, such that the yields or rate of production of a desired fine chemical by this microorganism is improved. The agent which modulates MP protein activity can be an agent which stimulates MP protein activity or MP nucleic acid expression. Examples of agents which stimulate MP protein activity or MP nucleic acid expression include small molecules, active MP proteins, and nucleic acids encoding MP proteins that have been introduced into the cell. Examples of agents which inhibit MP activity or expression include small molecules, and antisense MP nucleic acid molecules.

Another aspect of the invention pertains to methods for modulating yields of a desired compound from a cell, involving the introduction of a wild-type or mutant MP gene into a cell, either maintained on a separate plasmid or integrated into the genome of the host cell. If integrated into the genome, such integration can be random, or it can take place by homologous recombination such that the native gene is replaced by the introduced copy, causing the production of the desired compound from the cell to be modulated. In a preferred embodiment, said yields are increased. In another preferred embodiment, said chemical is a fine chemical. In a particularly preferred embodiment, said fine chemical is an amino acid. In especially preferred embodiments, said amino acid is L-lysine.

DETAILED DESCRIPTION OF THE INVENTION

The present invention provides MP nucleic acid and protein molecules which are involved in the metabolism of certain fine chemicals in *Corynebacterium glutamicum*, including amino acids, vitamins, cofactors, nutraceuticals, nucleotides, nucleosides, and trehalose. The molecules of the invention may be utilized in the modulation of production of fine chemicals from microorganisms, such as *C. glutamicum*, either directly (e.g., where modulation of the activity of a lysine biosynthesis protein has a direct impact on the production or efficiency of production of lysine from that organism), or may have an indirect impact which nonetheless results in an increase of yield or efficiency of production of the desired compound (e.g., where modulation of the activity of a nucleotide biosynthesis protein has an impact on the production of an organic acid or a fatty acid from the bacterium, perhaps due to improved growth or an increased supply of necessary cofactors, energy compounds, or precursor molecules). Aspects of the invention are further explicated below.

I. Fine Chemicals

The term 'fine chemical' is art-recognized and includes molecules produced by an organism which have applications in various industries, such as, but not limited to, the pharmaceutical, agriculture, and cosmetics industries. Such compounds include organic acids, such as tartaric acid, itaconic acid, and diaminopimelic acid, both proteinogenic and nonproteinogenic amino acids, purine and pyrimidine bases, nucleosides, and nucleotides (as described e.g. in Kuninaka, A. (1996) Nucleotides and related compounds, p. 561-612, in Biotechnology vol. 6, Rehm et al., eds. VCH: Weinheim, and references contained therein), lipids, both saturated and unsaturated fatty acids (e.g., arachidonic acid), diols (e.g., propane diol, and butane diol), carbohydrates (e.g., hyaluronic acid and trehalose), aromatic compounds (e.g., aromatic amines, vanillin, and indigo), vitamins and cofactors (as described in Ullmann's Encyclopedia of Industrial Chemistry, vol. A27, "Vitamins", p. 443-613 (1996) VCH: Weinheim and references therein; and Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1-3, 1994 at Penang, Malaysia, AOCS Press, (1995)), enzymes, polyketides (Cane et al. (1998) *Science* 282: 63-68), and all other chemicals described in Gutcho (1983) Chemicals by Fermentation, Noyes Data Corporation, ISBN: 0818805086 and references therein. The metabolism and uses of certain of these fine chemicals are further explicated below.

A. Amino Acid Metabolism and Uses

Amino acids comprise the basic structural units of all proteins, and as such are essential for normal cellular functioning in all organisms. The term "amino acid" is art-recognized. The proteinogenic amino acids, of which there are 20 species, serve as structural units for proteins, in which they are linked by peptide bonds, while the nonproteinogenic amino acids (hundreds of which are known) are not normally found in proteins (see Ulmann's Encyclopedia of Industrial Chemistry, vol. A2, p. 57-97 VCH: Weinheim (1985)). Amino acids may be in the D- or L-optical configuration, though L-amino acids are generally the only type found in naturally-occurring proteins. Biosynthetic and degradative pathways of each of the 20 proteinogenic amino acids have been well characterized in both prokaryotic and eukaryotic cells (see, for example, Stryer, L. Biochemistry, $3^{rd}$ edition, pages 578-590 (1988)). The 'essential' amino acids (histidine, isoleucine, leucine, lysine, methionine, phenylalanine, threonine, tryptophan, and valine), so named because they are generally a nutritional requirement due to the complexity of their biosyntheses, are readily converted by simple biosynthetic pathways to the remaining 11 'nonessential' amino acids (alanine, arginine, asparagine, aspartate, cysteine, glutamate, glutamine, glycine, proline, serine, and tyrosine). Higher animals do retain the ability to synthesize some of these amino acids, but the essential amino acids must be supplied from the diet in order for normal protein synthesis to occur.

Aside from their function in protein biosynthesis, these amino acids are interesting chemicals in their own right, and many have been found to have various applications in the food, feed, chemical, cosmetics, agriculture, and pharmaceutical industries. Lysine is an important amino acid in the nutrition not only of humans, but also of monogastric animals such as poultry and swine. Glutamate is most commonly used as a flavor additive (mono-sodium glutamate, MSG) and is widely used throughout the food industry, as are aspartate, phenylalanine, glycine, and cysteine. Glycine, L-methionine and tryptophan are all utilized in the pharmaceutical industry. Glutamine, valine, leucine, isoleucine, histidine, arginine, proline, serine and alanine are of use in both the pharmaceutical and cosmetics industries. Threonine, tryptophan, and D/L-methionine are common feed additives. (Leuchtenberger, W. (1996) Amino aids—technical production and use, p. 466-502 in Rehm et al. (eds.) Biotechnology vol. 6, chapter 14a, VCH: Weinheim). Additionally, these amino acids have been found to be useful as precursors for the synthesis of synthetic amino acids and proteins, such as N-acetylcysteine, S-carboxymethyl-L-cysteine, (S)-5-hydroxytryptophan, and others described in Ulmann's Encyclopedia of Industrial Chemistry, vol. A2, p. 57-97, VCH: Weinheim, 1985.

The biosynthesis of these natural amino acids in organisms capable of producing them, such as bacteria, has been well characterized (for review of bacterial amino acid biosynthesis and regulation thereof, see Umbarger, H. E. (1978) *Ann. Rev. Biochem.* 47: 533-606). Glutamate is synthesized by the reductive amination of α-ketoglutarate, an intermediate in the citric acid cycle. Glutamine, proline, and arginine are each subsequently produced from glutamate. The biosynthesis of serine is a three-step process beginning with 3-phosphoglycerate (an intermediate in glycolysis), and resulting in this amino acid after oxidation, transamination, and hydrolysis steps. Both cysteine and glycine are produced from serine; the former by the condensation of homocysteine with serine, and the latter by the transferal of the side-chain β-carbon atom to tetrahydrofolate, in a reaction catalyzed by serine transhydroxymethylase. Phenylalanine, and tyrosine are synthesized from the glycolytic and pentose phosphate pathway precursors erythrose 4-phosphate and phosphoenolpyruvate in a 9-step biosynthetic pathway that differ only at the final two steps after synthesis of prephenate. Tryptophan is also produced from these two initial molecules, but its synthesis is an 11-step pathway. Tyrosine may also be synthesized from phenylalanine, in a reaction catalyzed by phenylalanine hydroxylase. Alanine, valine, and leucine are all biosynthetic products of pyruvate, the final product of glycolysis. Aspartate is formed from oxaloacetate, an intermediate of the citric acid cycle. Asparagine, methionine, threonine, and lysine are each produced by the conversion of aspartate. Isoleucine is formed from threonine. A complex 9-step pathway results in the production of histidine from 5-phosphoribosyl-1-pyrophosphate, an activated sugar.

Amino acids in excess of the protein synthesis needs of the cell cannot be stored, and are instead degraded to provide intermediates for the major metabolic pathways of the cell (for review see Stryer, L. Biochemistry $3^{rd}$ ed. Ch. 21 "Amino Acid Degradation and the Urea Cycle" p. 495-516 (1988)). Although the cell is able to convert unwanted amino acids into useful metabolic intermediates, amino acid production is costly in terms of energy, precursor molecules, and the enzymes necessary to synthesize them. Thus it is not surprising that amino acid biosynthesis is regulated by feedback inhibition, in which the presence of a particular amino acid serves to slow or entirely stop its own production (for overview of feedback mechanisms in amino acid biosynthetic pathways, see Stryer, L. Biochemistry, $3^{rd}$ ed. Ch. 24: "Biosynthesis of Amino Acids and Heme" p. 575-600 (1988)). Thus, the output of any particular amino acid is limited by the amount of that amino acid present in the cell.

B. Vitamin, Cofactor, and Nutraceutical Metabolism and Uses

Vitamins, cofactors, and nutraceuticals comprise another group of molecules which the higher animals have lost the ability to synthesize and so must ingest, although they are readily synthesized by other organisms, such as bacteria. These molecules are either bioactive substances themselves, or are precursors of biologically active substances which may serve as electron carriers or intermediates in a variety of metabolic pathways. Aside from their nutritive value, these compounds also have significant industrial value as coloring agents, antioxidants, and catalysts or other processing aids. (For an overview of the structure, activity, and industrial applications of these compounds, see, for example, Ullman's Encyclopedia of Industrial Chemistry, "Vitamins" vol. A27, p. 443-613, VCH: Weinheim, 1996.) The term "vitamin" is art-recognized, and includes nutrients which are required by an organism for normal functioning, but which that organism cannot synthesize by itself. The group of vitamins may encompass cofactors and nutraceutical compounds. The language "cofactor" includes nonproteinaceous compounds required for a normal enzymatic activity to occur. Such compounds may be organic or inorganic; the cofactor molecules of the invention are preferably organic. The term "nutraceutical" includes dietary supplements having health benefits in plants and animals, particularly humans. Examples of such molecules are vitamins, antioxidants, and also certain lipids (e.g., polyunsaturated fatty acids).

The biosynthesis of these molecules in organisms capable of producing them, such as bacteria, has been largely characterized (Ullman's Encyclopedia of Industrial Chemistry, "Vitamins" vol. A27, p. 443-613, VCH: Weinheim, 1996; Michal, G. (1999) Biochemical Pathways: An Atlas of Biochemistry and Molecular Biology, John Wiley & Sons; Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1-3, 1994 at Penang, Malaysia, AOCS Press: Champaign, Ill. X, 374 S).

Thiamin (vitamin $B_1$) is produced by the chemical coupling of pyrimidine and thiazole moieties. Riboflavin (vitamin $B_2$) is synthesized from guanosine-5'-triphosphate (GTP) and ribose-5'-phosphate. Riboflavin, in turn, is utilized for the synthesis of flavin mononucleotide (FMN) and flavin adenine dinucleotide (FAD). The family of compounds collectively termed 'vitamin $B_6$' (e.g., pyridoxine, pyridoxamine, pyridoxa-5'-phosphate, and the commercially used pyridoxin hydrochloride) are all derivatives of the common structural unit, 5-hydroxy-6-methylpyridine. Pantothenate (pantothenic acid, (R)-(+)-N-(2,4-dihydroxy-3,3-dimethyl-1-oxobutyl)-β-alanine) can be produced either by chemical synthesis or by fermentation. The final steps in pantothenate biosynthesis consist of the ATP-driven condensation of β-alanine and pantoic acid. The enzymes responsible for the biosynthesis steps for the conversion to pantoic acid, to β-alanine and for the condensation to panthotenic acid are known. The metabolically active form of pantothenate is Coenzyme A, for which the biosynthesis proceeds in 5 enzymatic steps. Pantothenate, pyridoxal-5'-phosphate, cysteine and ATP are the precursors of Coenzyme A. These enzymes not only catalyze the formation of panthothante, but also the production of (R)-pantoic acid, (R)-pantolacton, (R)-panthenol (provitamin B$_5$), pantetheine (and its derivatives) and coenzyme A.

Biotin biosynthesis from the precursor molecule pimeloyl-CoA in microorganisms has been studied in detail and several of the genes involved have been identified. Many of the corresponding proteins have been found to also be involved in Fe-cluster synthesis and are members of the nifS class of proteins. Lipoic acid is derived from octanoic acid, and serves as a coenzyme in energy metabolism, where it becomes part of the pyruvate dehydrogenase complex and the α-ketoglutarate dehydrogenase complex. The folates are a group of substances which are all derivatives of folic acid, which is turn is derived from L-glutamic acid, p-amino-benzoic acid and 6-methylpterin. The biosynthesis of folic acid and its derivatives, starting from the metabolism intermediates guanosine-5'-triphosphate (GTP), L-glutamic acid and p-aminobenzoic acid has been studied in detail in certain microorganisms.

Corrinoids (such as the cobalamines and particularly vitamin B$_{12}$) and porphyrines belong to a group of chemicals characterized by a tetrapyrole ring system. The biosynthesis of vitamin B$_{12}$ is sufficiently complex that it has not yet been completely characterized, but many of the enzymes and substrates involved are now known. Nicotinic acid (nicotinate), and nicotinamide are pyridine derivatives which are also termed 'niacin'. Niacin is the precursor of the important coenzymes NAD (nicotinamide adenine dinucleotide) and NADP (nicotinamide adenine dinucleotide phosphate) and their reduced forms.

The large-scale production of these compounds has largely relied on cell-free chemical syntheses, though some of these chemicals have also been produced by large-scale culture of microorganisms, such as riboflavin, Vitamin B$_6$, pantothenate, and biotin. Only Vitamin B$_{12}$ is produced solely by fermentation, due to the complexity of its synthesis. In vitro methodologies require significant inputs of materials and time, often at great cost.

C. Purine, Pyrimidine, Nucleoside and Nucleotide Metabolism and Uses

Purine and pyrimidine metabolism genes and their corresponding proteins are important targets for the therapy of tumor diseases and viral infections. The language "purine" or "pyrimidine" includes the nitrogenous bases which are constituents of nucleic acids, co-enzymes, and nucleotides. The term "nucleotide" includes the basic structural units of nucleic acid molecules, which are comprised of a nitrogenous base, a pentose sugar (in the case of RNA, the sugar is ribose; in the case of DNA, the sugar is D-deoxyribose), and phosphoric acid. The language "nucleoside" includes molecules which serve as precursors to nucleotides, but which are lacking the phosphoric acid moiety that nucleotides possess. By inhibiting the biosynthesis of these molecules, or their mobilization to form nucleic acid molecules, it is possible to inhibit RNA and DNA synthesis; by inhibiting this activity in a fashion targeted to cancerous cells, the ability of tumor cells to divide and replicate may be inhibited. Additionally, there are nucleotides which do not form nucleic acid molecules, but rather serve as energy stores (i.e., AMP) or as coenzymes (i.e., FAD and NAD).

Several publications have described the use of these chemicals for these medical indications, by influencing purine and/or pyrimidine metabolism (e.g. Christopherson, R. I. and Lyons, S. D. (1990) "Potent inhibitors of de novo pyrimidine and purine biosynthesis as chemotherapeutic agents." Med. Res. Reviews 10: 505-548). Studies of enzymes involved in purine and pyrimidine metabolism have been focused on the development of new drugs which can be used, for example, as immunosuppressants or anti-proliferants (Smith, J. L., (1995) "Enzymes in nucleotide synthesis." Curr. Opin. Struct. Biol. 5: 752-757; (1995) Biochem Soc. Transact. 23: 877-902). However, purine and pyrimidine bases, nucleosides and nucleotides have other utilities: as intermediates in the biosynthesis of several fine chemicals (e.g., thiamine, S-adenosyl-methionine, folates, or riboflavin), as energy carriers for the cell (e.g., ATP or GTP), and for chemicals themselves, commonly used as flavor enhancers (e.g., IMP or GMP) or for several medicinal applications (see, for example, Kuninaka, A. (1996) Nucleotides and Related Compounds in Biotechnology vol. 6, Rehm et al., eds. VCH: Weinheim, p. 561-612). Also, enzymes involved in purine, pyrimidine, nucleoside, or nucleotide metabolism are increasingly serving as targets against which chemicals for crop protection, including fungicides, herbicides and insecticides, are developed.

The metabolism of these compounds in bacteria has been characterized (for reviews see, for example, Zalkin, H. and Dixon, J. E. (1992) "de novo purine nucleotide biosynthesis", in: Progress in Nucleic Acid Research and Molecular Biology, vol. 42, Academic Press:, p. 259-287; and Michal, G. (1999) "Nucleotides and Nucleosides", Chapter 8 in: Biochemical Pathways: An Atlas of Biochemistry and Molecular Biology, Wiley: New York). Purine metabolism has been the subject of intensive research, and is essential to the normal functioning of the cell. Impaired purine metabolism in higher animals can cause severe disease, such as gout. Purine nucleotides are synthesized from ribose-5-phosphate, in a series of steps through the intermediate compound inosine-5'-phosphate (IMP), resulting in the production of guanosine-5'-monophosphate (GMP) or adenosine-5'-monophosphate (AMP), from which the triphosphate forms utilized as nucleotides are readily formed. These compounds are also utilized as energy stores, so their degradation provides energy for many different biochemical processes in the cell. Pyrimidine biosynthesis proceeds by the formation of uridine-5'-monophosphate (UMP) from ribose-5-phosphate. UMP, in turn, is converted to cytidine-5'-triphosphate (CTP). The deoxyforms of all of these nucleotides are produced in a one step reduction reaction from the diphosphate ribose form of the nucleotide to the diphosphate deoxyribose form of the nucleotide. Upon phosphorylation, these molecules are able to participate in DNA synthesis.

D. Trehalose Metabolism and Uses

Trehalose consists of two glucose molecules, bound in α,α-1,1 linkage. It is commonly used in the food industry as a sweetener, an additive for dried or frozen foods, and in beverages. However, it also has applications in the pharmaceutical, cosmetics and biotechnology industries (see, for example, Nishimoto et al., (1998) U.S. Pat. No. 5,759,610; Singer, M. A. and Lindquist, S. (1998) Trends Biotech. 16: 460-467; Paiva, C. L. A. and Panek, A. D. (1996) Biotech. Ann. Rev. 2: 293-314; and Shiosaka, M. (1997) J. Japan 172: 97-102). Trehalose is produced by enzymes from many microorganisms and is naturally released into the surrounding medium, from which it can be collected using methods known in the art.

II. Elements and Methods of the Invention

The present invention is based, at least in part, on the discovery of novel molecules, referred to herein as MP nucleic acid and protein molecules, which play a role in or function in one or more cellular metabolic pathways. In one embodiment, the MP molecules catalyze an enzymatic reaction involving one or more amino acid, vitamin, cofactor, nutraceutical, nucleotide, nucleoside, or trehalose metabolic pathways. In a preferred embodiment, the activity of the MP molecules of the present invention in one or more *C. glutamicum* metabolic pathways for amino acids, vitamins, cofactors, nutraceuticals, nucleotides, nucleosides or trehalose has an impact on the production of a desired fine chemical by this organism. In a particularly preferred embodiment, the MP molecules of the invention are modulated in activity, such that the *C. glutamicum* metabolic pathways in which the MP proteins of the invention are involved are modulated in efficiency or output, which either directly or indirectly modulates the production or efficiency of production of a desired fine chemical by *C. glutamicum*.

The language, "MP protein" or "MP polypeptide" includes proteins which play a role in, e.g., catalyze an enzymatic reaction, in one or more amino acid, vitamin, cofactor, nutraceutical, nucleotide, nucleoside or trehalose metabolic pathways. Examples of MP proteins include those encoded by the MP genes set forth in Table 1 and Appendix A. The terms "MP gene" or "MP nucleic acid sequence" include nucleic acid sequences encoding an MP protein, which consist of a coding region and also corresponding untranslated 5' and 3' sequence regions. Examples of MP genes include those set forth in Table 1. The terms "production" or "productivity" are art-recognized and include the concentration of the fermentation product (for example, the desired fine chemical formed) within a given time and a given fermentation volume (e.g., kg product per hour per liter). The term "efficiency of production" includes the time required for a particular level of production to be achieved (for example, how long it takes for the cell to attain a particular rate of output of a fine chemical). The term "yield" or "product/carbon yield" is art-recognized and includes the efficiency of the conversion of the carbon source into the product (i.e., fine chemical). This is generally written as, for example, kg product per kg carbon source. By increasing the yield or production of the compound, the quantity of recovered molecules, or of useful recovered molecules of that compound in a given amount of culture over a given amount of time is increased. The terms "biosynthesis" or a "biosynthetic pathway" are art-recognized and include the synthesis of a compound, preferably an organic compound, by a cell from intermediate compounds in what may be a multistep and highly regulated process. The terms "degradation" or a "degradation pathway" are art-recognized and include the breakdown of a compound, preferably an organic compound, by a cell to degradation products (generally speaking, smaller or less complex molecules) in what may be a multistep and highly regulated process. The language "metabolism" is art-recognized and includes the totality of the biochemical reactions that take place in an organism. The metabolism of a particular compound, then, (e.g., the metabolism of an amino acid such as glycine) comprises the overall biosynthetic, modification, and degradation pathways in the cell related to this compound.

In another embodiment, the MP molecules of the invention are capable of modulating the production of a desired molecule, such as a fine chemical, in a microorganism such as *C. glutamicum*. Using recombinant genetic techniques, one or more of the biosynthetic or degradative enzymes of the invention for amino acids, vitamins, cofactors, nutraceuticals, nucleotides, nucleosides, or trehalose may be manipulated such that its function is modulated. For example, a biosynthetic enzyme may be improved in efficiency, or its allosteric control region destroyed such that feedback inhibition of production of the compound is prevented. Similarly, a degradative enzyme may be deleted or modified by substitution, deletion, or addition such that its degradative activity is lessened for the desired compound without impairing the viability of the cell. In each case, the overall yield or rate of production of one of these desired fine chemicals may be increased.

It is also possible that such alterations in the protein and nucleotide molecules of the invention may improve the production of other fine chemicals besides the amino acids, vitamins, cofactors, nutraceuticals, nucleotides, nucleosides, and trehalose. Metabolism of any one compound is necessarily intertwined with other biosynthetic and degradative pathways within the cell, and necessary cofactors, intermediates, or substrates in one pathway are likely supplied or limited by another such pathway. Therefore, by modulating the activity of one or more of the proteins of the invention, the production or efficiency of activity of another fine chemical biosynthetic or degradative pathway may be impacted. For example, amino acids serve as the structural units of all proteins, yet may be present intracellularly in levels which are limiting for protein synthesis; therefore, by increasing the efficiency of production or the yields of one or more amino acids within the cell, proteins, such as biosynthetic or degradative proteins, may be more readily synthesized. Likewise, an alteration in a metabolic pathway enzyme such that a particular side reaction becomes more or less favored may result in the over- or under-production of one or more compounds which are utilized as intermediates or substrates for the production of a desired fine chemical.

The isolated nucleic acid sequences of the invention are contained within the genome of a *Corynebacterium glutamicum* strain available through the American Type Culture Collection, given designation ATCC 13032. The nucleotide sequence of the isolated *C. glutamicum* MP DNAs and the predicted amino acid sequences of the *C. glutamicum* MP proteins are shown in Appendices A and B, respectively. Computational analyses were performed which classified and/or identified these nucleotide sequences as sequences which encode metabolic pathway proteins.

The present invention also pertains to proteins which have an amino acid sequence which is substantially homologous to an amino acid sequence of Appendix B. As used herein, a protein which has an amino acid sequence which is substantially homologous to a selected amino acid sequence is least about 50% homologous to the selected amino acid sequence, e.g., the entire selected amino acid sequence. A protein which has an amino acid sequence which is substantially homologous to a selected amino acid sequence can also be least about 50-60%, preferably at least about 60-70%, and more preferably at least about 70-80%, 80-90%, or 90-95%, and most preferably at least about 96%, 97%, 98%, 99% or more homologous to the selected amino acid sequence.

The MP protein or a biologically active portion or fragment thereof of the invention can catalyze an enzymatic reaction in one or more amino acid, vitamin, cofactor, nutraceutical, nucleotide, nucleoside, or trehalose metabolic pathways, or have one or more of the activities set forth in Table 1.

Various aspects of the invention are described in further detail in the following subsections:

A. Isolated Nucleic Acid Molecules

One aspect of the invention pertains to isolated nucleic acid molecules that encode MP polypeptides or biologically active portions thereof, as well as nucleic acid fragments sufficient for use as hybridization probes or primers for the identification or amplification of MP-encoding nucleic acid (e.g., MP DNA). As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 100 nucleotides of sequence upstream from the 5' end of the coding region and at least about 20 nucleotides of sequence downstream from the 3'end of the coding region of the gene. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated MP nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g, a *C. glutamicum* cell). Moreover, an "isolated" nucleic acid molecule, such as a DNA molecule, can be substantially free of other cellular material, or culture medium when produced by recombinant techniques, or chemical precursors or other chemicals when chemically synthesized.

A nucleic acid molecule of the present invention, e.g., a nucleic acid molecule having a nucleotide sequence of Appendix A, or a portion thereof, can be isolated using standard molecular biology techniques and the sequence information provided herein. For example, a *C. glutamicum* MP DNA can be isolated from a *C. glutamicum* library using all or portion of one of the sequences of Appendix A as a hybridization probe and standard hybridization techniques (e.g., as described in Sambrook, J., Fritsh, E. F., and Maniatis, T. *Molecular Cloning: A Laboratory Manual.* 2nd, ed, Cold Spring Harbor Laboratory, Cold Spring Harbor Laboratory Press, Cold Spring Harbor, N.Y., 1989). Moreover, a nucleic acid molecule encompassing all or a portion of one of the sequences of Appendix A can be isolated by the polymerase chain reaction using oligonucleotide primers designed based upon this sequence (e.g., a nucleic acid molecule encompassing all or a portion of one of the sequences of Appendix A can be isolated by the polymerase chain reaction using oligonucleotide primers designed based upon this same sequence of Appendix A). For example, mRNA can be isolated from normal endothelial cells (e.g., by the guanidinium-thiocyanate extraction procedure of Chirgwin et al. (1979) *Biochemistry* 18: 5294-5299) and DNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in Appendix A. A nucleic acid of the invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to an MP nucleotide sequence can be prepared by standard synthetic techniques, e.g., using an automated DNA synthesizer.

In a preferred embodiment, an isolated nucleic acid molecule of the invention comprises one of the nucleotide sequences shown in Appendix A. The sequences of Appendix A correspond to the *Corynebacterium glutamicum* MP DNAs of the invention. This DNA comprises sequences encoding MP proteins (i.e., the "coding region", indicated in each sequence in Appendix A), as well as 5' untranslated sequences and 3' untranslated sequences, also indicated in Appendix A. Alternatively, the nucleic acid molecule can comprise only the coding region of any of the sequences in Appendix A.

For the purposes of this application, it will be understood that each of the sequences set forth in Appendix A has an identifying RXA, RXN, RXS, or RXC number having the designation "RXA", "RXN", "RXS", or "RXC" followed by 5 digits (i.e., RXA00007, RXN00023, RXS00116, or RXC00128). Each of these sequences comprises up to three parts: a 5' upstream region, a coding region, and a downstream region. Each of these three regions is identified by the same RXA, RXN, RXS, or RXC designation to eliminate confusion. The recitation "one of the sequences in Appendix A", then, refers to any of the sequences in Appendix A, which may be distinguished by their differing RXA, RXN, RXS, or RXC designations. The coding region of each of these sequences is translated into a corresponding amino acid sequence, which is set forth in Appendix B. The sequences of Appendix B are identified by the same RXA, RXN, RXS, or RXC designations as Appendix A, such that they can be readily correlated. For example, the amino acid sequences in Appendix B designated RXA02229, RX00351, RXS02970, and RXC02390 are translations of the coding regions of the nucleotide sequences of nucleic acid molecules RXA02229, RX00351, RXS02970, and RXC02390, respectively, in Appendix A. Each of the RXA, RXN, RXS, and RXC nucleotide and amino acid sequences of the invention has also been assigned a SEQ ID NO, as indicated in Table 1.

Several of the genes of the invention are "F-designated genes". An F-designated gene includes those genes set forth in Table 1 which have an 'F' in front of the RXA, RXN, RXS, or RXC designation. For example, SEQ ID NO:5, designated, as indicated on Table 1, as "F RXA01009", is an F-designated gene, as are SEQ ID NOs: 73, 75, and 77 (designated on Table 1 as "F RXA00007", "F RXA00364", and "F RXA00367", respectively).

In one embodiment, the nucleic acid molecules of the present invention are not intended to include *C. glutamicum* those compiled in Table 2. In the case of the dapD gene, a sequence for this gene was published in Wehrmann, A., et al. (1998) *J. Bacteriol.* 180 (12): 3159-3165. However, the sequence obtained by the inventors of the present application is significantly longer than the published version. It is believed that the published version relied on an incorrect start codon, and thus represents only a fragment of the actual coding region.

In another preferred embodiment, an isolated nucleic acid molecule of the invention comprises a nucleic acid molecule which is a complement of one of the nucleotide sequences shown in Appendix A, or a portion thereof. A nucleic acid molecule which is complementary to one of the nucleotide sequences shown in Appendix A is one which is sufficiently complementary to one of the nucleotide sequences shown in Appendix A such that it can hybridize to one of the nucleotide sequences shown in Appendix A, thereby forming a stable duplex.

In still another preferred embodiment, an isolated nucleic acid molecule of the invention comprises a nucleotide sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to a nucleotide sequence shown in Appendix A, or a portion thereof. Ranges and identity values intermediate to the above-recited ranges, (e.g., 70-90% identical or 80-95% identical) are also intended to be encompassed by the present invention. For example, ranges of identity values using a combination of any of the above values recited as upper and/or lower limits are intended to be included. In an additional preferred embodiment, an isolated nucleic acid molecule of the invention comprises a nucleotide sequence which hybridizes, e.g., hybridizes under stringent conditions, to one of the nucleotide sequences shown in Appendix A, or a portion thereof.

Moreover, the nucleic acid molecule of the invention can comprise only a portion of the coding region of one of the sequences in Appendix A, for example a fragment which can be used as a probe or primer or a fragment encoding a biologically active portion of an MP protein. The nucleotide sequences determined from the cloning of the MP genes from *C. glutamicum* allows for the generation of probes and primers designed for use in identifying and/or cloning MP homologues in other cell types and organisms, as well as MP homologues from other *Corynebacteria* or related species. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth in Appendix A, an anti-sense sequence of one of the sequences set forth in Appendix A, or naturally occurring mutants thereof. Primers based on a nucleotide sequence of Appendix A can be used in PCR reactions to clone MP homologues. Probes based on the MP nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme co-factor. Such probes can be used as a part of a diagnostic test kit for identifying cells which misexpress an MP protein, such as by measuring a level of an MP-encoding nucleic acid in a sample of cells from a subject e.g., detecting MP mRNA levels or determining whether a genomic MP gene has been mutated or deleted.

In one embodiment, the nucleic acid molecule of the invention encodes a protein or portion thereof which includes an amino acid sequence which is sufficiently homologous to an amino acid sequence of Appendix B such that the protein or portion thereof maintains the ability to catalyze an enzymatic reaction in an amino acid, vitamin, cofactor, nutraceutical, nucleotide, nucleoside, or trehalose metabolic pathway. As used herein, the language "sufficiently homologous" refers to proteins or portions thereof which have amino acid sequences which include a minimum number of identical or equivalent (e.g., an amino acid residue which has a similar side chain as an amino acid residue in one of the sequences of Appendix B) amino acid residues to an amino acid sequence of Appendix B such that the protein or portion thereof is able to catalyze an enzymatic reaction in a *C. glutamicum* amino acid, vitamin, cofactor, nutraceutical, nucleotide, nucleoside or trehalose metabolic pathway. Protein members of such metabolic pathways, as described herein, function to catalyze the biosynthesis or degradation of one or more of: amino acids, vitamins, cofactors, nutraceuticals, nucleotides, nucleosides, or trehalose. Examples of such activities are also described herein. Thus, "the function of an MP protein" contributes to the overall functioning of one or more such metabolic pathway and contributes, either directly or indirectly, to the yield, production, and/or efficiency of production of one or more fine chemicals. Examples of MP protein activities are set forth in Table 1.

In another embodiment, the protein is at least about 50-60%, preferably at least about 60-70%, and more preferably at least about 70-80%, 80-90%, 90-95%, and most preferably at least about 96%, 97%, 98%, 99% or more homologous to an entire amino acid sequence of Appendix B.

Portions of proteins encoded by the MP nucleic acid molecules of the invention are preferably biologically active portions of one of the MP proteins. As used herein, the term "biologically active portion of an MP protein" is intended to include a portion, e.g., a domain/motif, of an MP protein that catalyzes an enzymatic reaction in one or more *C. glutamicum* amino acid, vitamin, cofactor, nutraceutical, nucleotide, nucleoside, or trehalose metabolic pathways, or has an activity as set forth in Table 1. To determine whether an MP protein or a biologically active portion thereof can catalyze an enzymatic reaction in an amino acid, vitamin, cofactor, nutraceutical, nucleotide, nucleoside, or trehalose metabolic pathway, an assay of enzymatic activity may be performed. Such assay methods are well known to those of ordinary skill in the art, as detailed in Example 8 of the Exemplification.

Additional nucleic acid fragments encoding biologically active portions of an MP protein can be prepared by isolating a portion of one of the sequences in Appendix B, expressing the encoded portion of the MP protein or peptide (e.g., by recombinant expression in vitro) and assessing the activity of the encoded portion of the MP protein or peptide.

The invention further encompasses nucleic acid molecules that differ from one of the nucleotide sequences shown in Appendix A (and portions thereof) due to degeneracy of the genetic code and thus encode the same MP protein as that encoded by the nucleotide sequences shown in Appendix A. In another embodiment, an isolated nucleic acid molecule of the invention has a nucleotide sequence encoding a protein having an amino acid sequence shown in Appendix B. In a still further embodiment, the nucleic acid molecule of the invention encodes a full length *C. glutamicum* protein which is substantially homologous to an amino acid sequence of Appendix B (encoded by an open reading frame shown in Appendix A).

It will be understood by one of ordinary skill in the art that in one embodiment the sequences of the invention are not meant to include the sequences of the prior art, such as those Genbank sequences set forth in Tables 2 or 4 which were available prior to the present invention. In one embodiment, the invention includes nucleotide and amino acid sequences having a percent identity to a nucleotide or amino acid sequence of the invention which is greater than that of a sequence of the prior art (e.g., a Genbank sequence (or the protein encoded by such a sequence) set forth in Tables 2 or 4). For example, the invention includes a nucleotide sequence which is greater than and/or at least 40% identical to the nucleotide sequence designated RXA00115 (SEQ ID NO:185), a nucleotide sequence which is greater than and/or at least % identical to the nucleotide sequence designated RXA00131 (SEQ ID NO:991), and a nucleotide sequence which is greater than and/or at least 39% identical to the nucleotide sequence designated RXA00219 (SEQ ID NO:345). One of ordinary skill in the art would be able to calculate the lower threshold of percent identity for any given sequence of the invention by examining the GAP-calculated percent identity scores set forth in Table 4 for each of the three top hits for the given sequence, and by subtracting the highest GAP-calculated percent identity from 100 percent. One of ordinary skill in the art will also appreciate that nucleic acid and amino acid sequences having percent identities greater than the lower threshold so calculated (e.g., at least 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more identical) are also encompassed by the invention.

In addition to the *C. glutamicum* MP nucleotide sequences shown in Appendix A, it will be appreciated by one of ordinary skill in the art that DNA sequence polymorphisms that lead to changes in the amino acid sequences of MP proteins may exist within a population (e.g., the *C. glutamicum* population). Such genetic polymorphism in the MP gene may exist among individuals within a population due to natural variation. As used herein, the terms "gene" and "recombinant gene" refer to nucleic acid molecules comprising an open reading frame encoding an MP protein, preferably a *C. glutamicum* MP protein. Such natural variations can typically result in 1-5% variance in the nucleotide sequence of the MP gene. Any and all such nucleotide variations and resulting amino acid polymorphisms in MP that are the result of natural variation and that do not alter the functional activity of MP proteins are intended to be within the scope of the invention.

Nucleic acid molecules corresponding to natural variants and non-*C. glutamicum* homologues of the *C. glutamicum* MP DNA of the invention can be isolated based on their homology to the *C. glutamicum* MP nucleic acid disclosed herein using the *C. glutamicum* DNA, or a portion thereof, as a hybridization probe according to standard hybridization techniques under stringent hybridization conditions. Accordingly, in another embodiment, an isolated nucleic acid molecule of the invention is at least 15 nucleotides in length and hybridizes under stringent conditions to the nucleic acid molecule comprising a nucleotide sequence of Appendix A. In other embodiments, the nucleic acid is at least 30, 50, 100, 250 or more nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 65%, more preferably at least about 70%, and even more preferably at least about 75% or more homologous to each other typically remain hybridized to each other. Such stringent conditions are known to one of ordinary skill in the art and can be found in *Current Protocols in Molecular Biology*, John Wiley & Sons, N.Y. (1989), 6.3.1-6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50-65° C. Preferably, an isolated nucleic acid molecule of the invention that hybridizes under stringent conditions to a sequence of Appendix A corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *C. glutamicum* MP protein.

In addition to naturally-occurring variants of the MP sequence that may exist in the population, one of ordinary skill in the art will further appreciate that changes can be introduced by mutation into a nucleotide sequence of Appendix A, thereby leading to changes in the amino acid sequence of the encoded MP protein, without altering the functional ability of the MP protein. For example, nucleotide substitutions leading to amino acid substitutions at "non-essential" amino acid residues can be made in a sequence of Appendix A. A "non-essential" amino acid residue is a residue that can be altered from the wild-type sequence of one of the MP proteins (Appendix B) without altering the activity of said MP protein, whereas an "essential" amino acid residue is required for MP protein activity. Other amino acid residues, however, (e.g., those that are not conserved or only semi-conserved in the domain having MP activity) may not be essential for activity and thus are likely to be amenable to alteration without altering MP activity.

Accordingly, another aspect of the invention pertains to nucleic acid molecules encoding MP proteins that contain changes in amino acid residues that are not essential for MP activity. Such MP proteins differ in amino acid sequence from a sequence contained in Appendix B yet retain at least one of the MP activities described herein. In one embodiment, the isolated nucleic acid molecule comprises a nucleotide sequence encoding a protein, wherein the protein comprises an amino acid sequence at least about 50% homologous to an amino acid sequence of Appendix B and is capable of catalyzing an enzymatic reaction in an amino acid, vitamin, cofactor, nutraceutical, nucleotide, nucleoside, or trehalose metabolic pathway, or has one or more activities set forth in Table 1. Preferably, the protein encoded by the nucleic acid molecule is at least about 50-60% homologous to one of the sequences in Appendix B, more preferably at least about 60-70% homologous to one of the sequences in Appendix B, even more preferably at least about 70-80%, 80-90%, 90-95% homologous to one of the sequences in Appendix B, and most preferably at least about 96%, 97%, 98%, or 99% homologous to one of the sequences in Appendix B.

To determine the percent homology of two amino acid sequences (e.g., one of the sequences of Appendix B and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g., one of the sequences of Appendix B) is occupied by the same amino acid residue or nucleotide as the corresponding position in the other sequence (e.g., a mutant form of the sequence selected from Appendix B), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

An isolated nucleic acid molecule encoding an MP protein homologous to a protein sequence of Appendix B can be created by introducing one or more nucleotide substitutions, additions or deletions into a nucleotide sequence of Appendix A such that one or more amino acid substitutions, additions or deletions are introduced into the encoded protein. Mutations can be introduced into one of the sequences of Appendix A by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in an MP protein is preferably replaced with another amino acid residue from the same side chain family. Alternatively, in another embodiment, mutations can be introduced randomly along all or part of an MP coding sequence, such as by saturation mutagenesis, and the resultant mutants can be screened for an MP activity described herein to identify mutants that retain MP activity. Following mutagenesis of one of the sequences of Appendix A, the encoded protein can be expressed recombinantly and the activity of the protein can be determined using, for example, assays described herein (see Example 8 of the Exemplification).

In addition to the nucleic acid molecules encoding MP proteins described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded DNA molecule or complementary to an mRNA sequence. Accordingly, an antisense nucleic acid can hydrogen bond to a sense nucleic acid. The antisense nucleic acid can be complementary to an entire MP coding strand, or to only a portion thereof. In one embodiment, an antisense nucleic acid molecule is antisense to a "coding region" of the coding strand of a nucleotide sequence encoding an MP protein. The term "coding region" refers to the region of the nucleotide sequence comprising codons which are translated into amino acid residues (e.g., the entire coding region of SEQ ID NO. 1 (RXA02229) comprises nucleotides 1 to 825). In another embodiment, the antisense nucleic acid molecule is antisense to a "noncoding region" of the coding strand of a nucleotide sequence encoding MP. The term "noncoding region" refers to 5' and 3' sequences which flank the coding region that are not translated into amino acids (i.e., also referred to as 5' and 3' untranslated regions).

Given the coding strand sequences encoding MP disclosed herein (e.g., the sequences set forth in Appendix A), antisense nucleic acids of the invention can be designed according to the rules of Watson and Crick base pairing. The antisense nucleic acid molecule can be complementary to the entire coding region of MP mRNA, but more preferably is an oligonucleotide which is antisense to only a portion of the coding or noncoding region of MP mRNA. For example, the antisense oligonucleotide can be complementary to the region surrounding the translation start site of MP mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding an MCT protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave MP mRNA transcripts to thereby inhibit translation of MP mRNA. A ribozyme having specificity for an MP-encoding nucleic acid can be designed based upon the nucleotide sequence of an MP DNA disclosed herein (i.e., SEQ ID NO: 1 (RXA02229 in Appendix A). For example, a derivative of a *Tetrahymena* L-19 IVS RNA can be constructed in which the nucleotide sequence of the active site is complementary to the nucleotide sequence to be cleaved in an MP-encoding mRNA. See, e.g., Cech et al. U.S. Pat. No. 4,987,071 and Cech et al. U.S. Pat. No. 5,116,742. Alternatively, MP mRNA can be used to select a catalytic RNA having a specific ribonuclease activity from a pool of RNA molecules. See, e.g., Bartel, D. and Szostak, J. W. (1993) *Science* 261:1411-1418.

Alternatively, MP gene expression can be inhibited by targeting nucleotide sequences complementary to the regulatory region of an MP nucleotide sequence (e.g., an MP promoter and/or enhancers) to form triple helical structures that prevent transcription of an MP gene in target cells. See generally, Helene, C. (1991) *Anticancer Drug Des.* 6 (6):569-84; Helene, C. et al. (1992) *Ann. N.Y. Acad. Sci.* 660:27-36; and Maher, L. J. (1992) *Bioassays* 14 (12):807-15.

B. Recombinant Expression Vectors and Host Cells

Another aspect of the invention pertains to vectors, preferably expression vectors, containing a nucleic acid encoding an MP protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, repressor binding sites, activator binding sites, enhancers and other expression control elements (e.g., terminators, polyadenylation signals, or other elements of mRNA secondary structure). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells. Preferred regulatory sequences are, for example, promoters such as cos-, tac-, trp-, tet-, trp-tet-, lpp-, lac-, lpp-lac-, lacI$^q$-, T7-, T5-, T3-, gal-, trc-, ara-, SP6-, arny, SPO2, $\lambda$-P$_R$- or $\lambda$ P$_L$, which are used preferably in bacteria. Additional regulatory sequences are, for example, promoters from yeasts and fungi, such as ADC1, MF$\alpha$, AC, P-60, CYC1, GAPDH, TEF, rp28, ADH, promoters from plants such as CaMV/35S, SSU, OCS, lib4, usp, STLS1, B33, nos or ubiquitin- or phaseolin-promoters. It is also possible to use artificial promoters. It will be appreciated by one of ordinary skill in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., MP proteins, mutant forms of MP proteins, fusion proteins, etc.).

The recombinant expression vectors of the invention can be designed for expression of MP proteins in prokaryotic or eukaryotic cells. For example, MP genes can be expressed in bacterial cells such as *C. glutamicum*, insect cells (using baculovirus expression vectors), yeast and other fungal cells (see Romanos, M. A. et al. (1992) "Foreign gene expression in yeast: a review", *Yeast* 8: 423-488; van den Hondel, C. A. M. J. J. et al. (1991) "Heterologous gene expression in filamentous fungi" in: More Gene Manipulations in Fungi, J. W. Bennet & L. L. Lasure, eds., p. 396-428: Academic Press: San Diego; and van den Hondel, C. A. M. J. J. & Punt, P. J. (1991) "Gene transfer systems and vector development for filamentous fungi, in: Applied Molecular Genetics of Fungi, Peberdy, J. F. et al., eds., p. 1-28, Cambridge University Press: Cambridge), algae and multicellular plant cells (see Schmidt, R. and Willmitzer, L. (1988) High efficiency *Agrobacterium tumefaciens*—mediated transformation of *Arabidopsis thaliana* leaf and cotyledon explants" *Plant Cell Rep.*: 583-586), or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein but also to the C-terminus or fused within suitable regions in the proteins. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the MP protein is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant MP protein unfused to GST can be recovered by cleavage of the fusion protein with thrombin.

Examples of suitable inducible non-fusion *E. coli* expression vectors include pTrc (Amann et al., (1988) *Gene* 69:301-315) pLG338, pACYC184, pBR322, pUC18, pUC19, pKC30, pRep4, pHS1, pHS2, pPLc236, pMBL24, pLG200, pUR290, pIN-III113-B1, λgt11, pBdCl, and pET 11d (Studier et al., *Gene Expression Technology: Methods in Enzymology* 185, Academic Press, San Diego, Calif. (1990) 60-89; and Pouwels et al., eds. (1985) Cloning Vectors. Elsevier: New York IBSN 0 444 904018). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174 (DE3) from a resident λ prophage harboring a T7 gn1 gene under the transcriptional control of the lacUV 5 promoter. For transformation of other varieties of bacteria, appropriate vectors may be selected. For example, the plasmids pIJ101, pIJ364, pIJ702 and pIJ361 are known to be useful in transforming *Streptomyces*, while plasmids pUB110, pC194, or pBD214 are suited for transformation of *Bacillus* species. Several plasmids of use in the transfer of genetic information into *Corynebacterium* include pHM1519, pBL1, pSA77, or pAJ667 (Pouwels et al., eds. (1985) Cloning Vectors. Elsevier: New York IBSN 0 444 904018).

One strategy to maximize recombinant protein expression is to express the protein in a host bacteria with an impaired capacity to proteolytically cleave the recombinant protein (Gottesman, S., *Gene Expression Technology. Methods in Enzymology* 185, Academic Press, San Diego, Calif. (1990) 119-128). Another strategy is to alter the nucleic acid sequence of the nucleic acid to be inserted into an expression vector so that the individual codons for each amino acid are those preferentially utilized in the bacterium chosen for expression, such as *C. glutamicum* (Wada et al. (1992) *Nucleic Acids Res.* 20:2111-2118). Such alteration of nucleic acid sequences of the invention can be carried out by standard DNA synthesis techniques.

In another embodiment, the MP protein expression vector is a yeast expression vector. Examples of vectors for expression in yeast *S. cerevisiae* include pYepSec1 (Baldari, et al., (1987) *Embo J.* 6:229-234), 2μ, pAG-1, Yep6, Yep13, pEMBLYe23, pMFa (Kurjan and Herskowitz, (1982) *Cell* 30:933-943), pJRY88 (Schultz et al., (1987) *Gene* 54:113-123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi, in: Applied Molecular Genetics of Fungi, J. F. Peberdy, et al., eds., p. 1-28, Cambridge University Press: Cambridge, and Pouwels et al., eds. (1985) Cloning Vectors. Elsevier: New York (IBSN 0 444 904018).

Alternatively, the MP proteins of the invention can be expressed in insect cells using baculovirus expression vectors. Baculovirus vectors available for expression of proteins in cultured insect cells (e.g., Sf 9 cells) include the pAc series (Smith et al. (1983) *Mol. Cell Biol.* 3:2156-2165) and the pVL series (Lucklow and Summers (1989) *Virology* 170:31-39).

In another embodiment, the MP proteins of the invention may be expressed in unicellular plant cells (such as algae) or in plant cells from higher plants (e.g., the spermatophytes, such as crop plants). Examples of plant expression vectors include those detailed in: Becker, D., Kemper, E., Schell, J. and Masterson, R. (1992) "New plant binary vectors with selectable markers located proximal to the left border", *Plant Mol. Biol.* 20: 1195-1197; and Bevan, M. W. (1984) "Binary *Agrobacterium* vectors for plant transformation", *Nucl. Acid. Res.* 12: 8711-8721, and include pLGV23, pGHlac+, pBIN19, pAK2004, and pDH51 (Pouwels et al., eds. (1985) Cloning Vectors. Elsevier: New York IBSN 0 444 904018).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning: A Laboratory Manual. 2nd, ed., Cold Spring Harbor Laboratory*, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *PNAS* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374-379) and the α-fetoprotein promoter (Campes and Tilghman (1989) *Genes Dev.* 3:537-546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to MP mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al., Antisense RNA as a molecular tool for genetic analysis, Reviews—Trends in Genetics, Vol. 1 (1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an MP protein can be expressed in bacterial cells such as C. glutamicum, insect cells, yeast or mammalian cells (such as Chinese hamster ovary cells (CHO) or COS cells). Other suitable host cells are known to those of ordinary skill in the art. Microorganisms related to Corynebacterium glutamicum which may be conveniently used as host cells for the nucleic acid and protein molecules of the invention are set forth in Table 3.

Vector DNA can be introduced into prokaryotic or eukaryotic cells via conventional transformation or transfection techniques. As used herein, the terms "transformation" and "transfection", "conjugation" and "transduction" are intended to refer to a variety of art-recognized techniques for introducing foreign nucleic acid (e.g., linear DNA or RNA (e.g., a linearized vector or a gene construct alone without a vector) or nucleic acid in the form of a vector (e.g., a plasmid, phage, phasmid, phagemid, transposon or other DNA) into a host cell, including calcium phosphate or calcium chloride co-precipitation, DEAE-dextran-mediated transfection, lipofection, natural competence, chemical-mediated transfer, or electroporation. Suitable methods for transforming or transfecting host cells can be found in Sambrook, et al. (*Molecular Cloning: A Laboratory Manual. 2nd, ed., Cold Spring Harbor Laboratory*, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an MP protein or can be introduced on a separate vector. Cells stably transfected with the introduced nucleic acid can be identified by drug selection (e.g., cells that have incorporated the selectable marker gene will survive, while the other cells die).

To create a homologous recombinant microorganism, a vector is prepared which contains at least a portion of an MP gene into which a deletion, addition or substitution has been introduced to thereby alter, e.g., functionally disrupt, the MP gene. Preferably, this MP gene is a *Corynebacterium glutamicum* MP gene, but it can be a homologue from a related bacterium or even from a mammalian, yeast, or insect source. In a preferred embodiment, the vector is designed such that, upon homologous recombination, the endogenous MP gene is functionally disrupted (i.e., no longer encodes a functional protein; also referred to as a "knock out" vector). Alternatively, the vector can be designed such that, upon homologous recombination, the endogenous MP gene is mutated or otherwise altered but still encodes functional protein (e.g., the upstream regulatory region can be altered to thereby alter the expression of the endogenous MP protein). In the homologous recombination vector, the altered portion of the MP gene is flanked at its 5' and 3' ends by additional nucleic acid of the MP gene to allow for homologous recombination to occur between the exogenous MP gene carried by the vector and an endogenous MP gene in a microorganism. The additional flanking MP nucleic acid is of sufficient length for successful homologous recombination with the endogenous gene. Typically, several kilobases of flanking DNA (both at the 5' and 3' ends) are included in the vector (see e.g., Thomas, K. R., and Capecchi, M. R. (1987) Cell 51: 503 for a description of homologous recombination vectors). The vector is introduced into a microorganism (e.g., by electroporation) and cells in which the introduced MP gene has homologously recombined with the endogenous MP gene are selected, using art-known techniques.

In another embodiment, recombinant microorganisms can be produced which contain selected systems which allow for regulated expression of the introduced gene. For example, inclusion of an MP gene on a vector placing it under control of the lac operon permits expression of the MP gene only in the presence of IPTG. Such regulatory systems are well known in the art.

In another embodiment, an endogenous MP gene in a host cell is disrupted (e.g., by homologous recombination or other genetic means known in the art) such that expression of its protein product does not occur. In another embodiment, an endogenous or introduced MP gene in a host cell has been altered by one or more point mutations, deletions, or inversions, but still encodes a functional MP protein. In still another embodiment, one or more of the regulatory regions (e.g., a promoter, repressor, or inducer) of an MP gene in a microorganism has been altered (e.g., by deletion, truncation, inversion, or point mutation) such that the expression of the MP gene is modulated. One of ordinary skill in the art will appreciate that host cells containing more than one of the described MP gene and protein modifications may be readily produced using the methods of the invention, and are meant to be included in the present invention.

A host cell of the invention, such as a prokaryotic or eukaryotic host cell in culture, can be used to produce (i.e., express) an MP protein. Accordingly, the invention further provides methods for producing MP proteins using the host cells of the invention. In one embodiment, the method comprises culturing the host cell of invention (into which a recombinant expression vector encoding an MP protein has been introduced, or into which genome has been introduced a gene encoding a wild-type or altered MP protein) in a suitable medium until MP protein is produced. In another embodiment, the method further comprises isolating MP proteins from the medium or the host cell.

C. Isolated MP Proteins

Another aspect of the invention pertains to isolated MP proteins, and biologically active portions thereof. An "isolated" or "purified" protein or biologically active portion thereof is substantially free of cellular material when produced by recombinant DNA techniques, or chemical precursors or other chemicals when chemically synthesized. The language "substantially free of cellular material" includes preparations of MP protein in which the protein is separated from cellular components of the cells in which it is naturally or recombinantly produced. In one embodiment, the language "substantially free of cellular material" includes preparations of MP protein having less than about 30% (by dry weight) of non-MP protein (also referred to herein as a "contaminating protein"), more preferably less than about 20% of non-MP protein, still more preferably less than about 10% of non-MP protein, and most preferably less than about 5% non-MP protein. When the MP protein or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of MP protein in which the protein is separated from chemical precursors or other chemicals which are involved in the synthesis of the protein. In one embodiment, the language "substantially free of chemical precursors or other chemicals" includes preparations of MP protein having less than about 30% (by dry weight) of chemical precursors or non-MP chemicals, more preferably less than about 20% chemical precursors or non-MP chemicals, still more preferably less than about 10% chemical precursors or non-MP chemicals, and most preferably less than about 5% chemical precursors or non-MP chemicals. In preferred embodiments, isolated proteins or biologically active portions thereof lack contaminating proteins from the same organism from which the MP protein is derived. Typically, such proteins are produced by recombinant expression of, for example, a *C. glutamicum* MP protein in a microorganism such as *C. glutamicum*.

An isolated MP protein or a portion thereof of the invention can catalyze an enzymatic reaction in an amino acid, vitamin, cofactor, nutraceutical, nucleotide, nucleoside, or trehalose metabolic pathway, or has one or more of the activities set forth in Table 1. In preferred embodiments, the protein or portion thereof comprises an amino acid sequence which is sufficiently homologous to an amino acid sequence of Appendix B such that the protein or portion thereof maintains the ability to catalyze an enzymatic reaction in an amino acid, vitamin, cofactor, nutraceutical, nucleotide, nucleoside, or trehalose metabolic pathway. The portion of the protein is preferably a biologically active portion as described herein. In another preferred embodiment, an MP protein of the invention has an amino acid sequence shown in Appendix B. In yet another preferred embodiment, the MP protein has an amino acid sequence which is encoded by a nucleotide sequence which hybridizes, e.g., hybridizes under stringent conditions, to a nucleotide sequence of Appendix A. In still another preferred embodiment, the MP protein has an amino acid sequence which is encoded by a nucleotide sequence that is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to one of the nucleic acid sequences of Appendix A, or a portion thereof. Ranges and identity values intermediate to the above-recited values, (e.g., 70-90% identical or 80-95% identical) are also intended to be encompassed by the present invention. For example, ranges of identity values using a combination of any of the above values recited as upper and/or lower limits are intended to be included. The preferred MP proteins of the present invention also preferably possess at least one of the MP activities described herein. For example, a preferred MP protein of the present invention includes an amino acid sequence encoded by a nucleotide sequence which hybridizes, e.g., hybridizes under stringent conditions, to a nucleotide sequence of Appendix A, and which can catalyze an enzymatic reaction in an amino acid, vitamin, cofactor, nutraceutical, nucleotide, nucleoside, or trehalose metabolic pathway, or which has one or more of the activities set forth in Table 1.

In other embodiments, the MP protein is substantially homologous to an amino acid sequence of Appendix B and retains the functional activity of the protein of one of the sequences of Appendix B yet differs in amino acid sequence due to natural variation or mutagenesis, as described in detail in subsection I above. Accordingly, in another embodiment, the MP protein is a protein which comprises an amino acid sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to an entire amino acid sequence of Appendix B and which has at least one of the MP activities described herein. Ranges and identity values intermediate to the above-recited values, (e.g., 70-90% identical or 80-95% identical) are also intended to be encompassed by the present invention. For example, ranges of identity values using a combination of any of the above values recited as upper and/or lower limits are intended to be included. In another embodiment, the invention pertains to a full length *C. glutamicum* protein which is substantially homologous to an entire amino acid sequence of Appendix B.

Biologically active portions of an MP protein include peptides comprising amino acid sequences derived from the amino acid sequence of an MP protein, e.g., the an amino acid sequence shown in Appendix B or the amino acid sequence of a protein homologous to an MP protein, which include fewer amino acids than a full length MP protein or the full length protein which is homologous to an MP protein, and exhibit at least one activity of an MP protein. Typically, biologically active portions (peptides, e.g., peptides which are, for example, 5, 10, 15, 20, 30, 35, 36, 37, 38, 39, 40, 50, 100 or more amino acids in length) comprise a domain or motif with at least one activity of an MP protein. Moreover, other biologically active portions, in which other regions of the protein are deleted, can be prepared by recombinant techniques and evaluated for one or more of the activities described herein. Preferably, the biologically active portions of an MP protein include one or more selected domains/motifs or portions thereof having biological activity.

MP proteins are preferably produced by recombinant DNA techniques. For example, a nucleic acid molecule encoding the protein is cloned into an expression vector (as described above), the expression vector is introduced into a host cell (as described above) and the MP protein is expressed in the host cell. The MP protein can then be isolated from the cells by an appropriate purification scheme using standard protein purification techniques. Alternative to recombinant expression, an MP protein, polypeptide, or peptide can be synthesized chemically using standard peptide synthesis techniques. Moreover, native MP protein can be isolated from cells (e.g., endothelial cells), for example using an anti-MP antibody, which can be produced by standard techniques utilizing an MP protein or fragment thereof of this invention.

The invention also provides MP chimeric or fusion proteins. As used herein, an MP "chimeric protein" or "fusion protein" comprises an MP polypeptide operatively linked to a non-MP polypeptide. An "MP polypeptide" refers to a polypeptide having an amino acid sequence corresponding to MP, whereas a "non-MP polypeptide" refers to a polypeptide having an amino acid sequence corresponding to a protein which is not substantially homologous to the MP protein, e.g., a protein which is different from the MP protein and which is derived from the same or a different organism. Within the fusion protein, the term "operatively linked" is intended to indicate that the MP polypeptide and the non-MP polypeptide are fused in-frame to each other. The non-MP polypeptide can be fused to the N-terminus or C-terminus of the MP polypeptide. For example, in one embodiment the fusion protein is a GST-MP fusion protein in which the MP sequences are fused to the C-terminus of the GST sequences. Such fusion proteins can facilitate the purification of recombinant MP proteins. In another embodiment, the fusion protein is an MP protein containing a heterologous signal sequence at its N-terminus. In certain host cells (e.g., mammalian host cells), expression and/or secretion of an MP protein can be increased through use of a heterologous signal sequence.

Preferably, an MP chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). An MP-encoding nucleic acid can be cloned into such an expression vector such that the fusion moiety is linked in-frame to the MP protein.

Homologues of the MP protein can be generated by mutagenesis, e.g., discrete point mutation or truncation of the MP protein. As used herein, the term "homologue" refers to a variant form of the MP protein which acts as an agonist or antagonist of the activity of the MP protein. An agonist of the MP protein can retain substantially the same, or a subset, of the biological activities of the MP protein. An antagonist of the MP protein can inhibit one or more of the activities of the naturally occurring form of the MP protein, by, for example, competitively binding to a downstream or upstream member of the MP cascade which includes the MP protein. Thus, the *C. glutamicum* MP protein and homologues thereof of the present invention may modulate the activity of one or more metabolic pathways in which MP proteins play a role in this microorganism.

In an alternative embodiment, homologues of the MP protein can be identified by screening combinatorial libraries of mutants, e.g., truncation mutants, of the MP protein for MP protein agonist or antagonist activity. In one embodiment, a variegated library of MP variants is generated by combinatorial mutagenesis at the nucleic acid level and is encoded by a variegated gene library. A variegated library of MP variants can be produced by, for example, enzymatically ligating a mixture of synthetic oligonucleotides into gene sequences such that a degenerate set of potential MP sequences is expressible as individual polypeptides, or alternatively, as a set of larger fusion proteins (e.g., for phage display) containing the set of MP sequences therein. There are a variety of methods which can be used to produce libraries of potential MP homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential MP sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the MP protein coding can be used to generate a variegated population of MP fragments for screening and subsequent selection of homologues of an MP protein. In one embodiment, a library of coding sequence fragments can be generated by treating a double stranded PCR fragment of an MP coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the MP protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of MP homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify MP homologues (Arkin and Yourvan (1992) *PNAS* 89:7811-7815; Delgrave et al. (1993) *Protein Engineering* 6 (3):327-331).

In another embodiment, cell based assays can be exploited to analyze a variegated MP library, using methods well known in the art.

D. Uses and Methods of the Invention

The nucleic acid molecules, proteins, protein homologues, fusion proteins, primers, vectors, and host cells described herein can be used in one or more of the following methods: identification of *C. glutamicum* and related organisms; mapping of genomes of organisms related to *C. glutamicum*; identification and localization of *C. glutamicum* sequences of interest; evolutionary studies; determination of MP protein regions required for function; modulation of an MP protein activity; modulation of the activity of an MP pathway; and modulation of cellular production of a desired compound, such as a fine chemical.

The MP nucleic acid molecules of the invention have a variety of uses. First, they may be used to identify an organism as being *Corynebacterium glutamicum* or a close relative thereof. Also, they may be used to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is not pathogenic to humans, it is related to species which are human pathogens, such as *Corynebacterium diphtheriae*. *Corynebacterium diphtheriae* is the causative agent of diphtheria, a rapidly developing, acute, febrile infection which involves both local and systemic pathology. In this disease, a local lesion develops in the upper respiratory tract and involves necrotic injury to epithelial cells; the bacilli secrete toxin which is disseminated through this lesion to distal susceptible tissues of the body. Degenerative changes brought about by the inhibition of protein synthesis in these tissues, which include heart, muscle, peripheral nerves, adrenals, kidneys, liver and spleen, result in the systemic pathology of the disease. Diphtheria continues to have high incidence in many parts of the world, including Africa, Asia, Eastern Europe and the independent states of the former Soviet Union. An ongoing epidemic of diphtheria in the latter two regions has resulted in at least 5,000 deaths since 1990.

In one embodiment, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject. *C. glutamicum* and *C. diphtheriae* are related bacteria, and many of the nucleic acid and protein molecules in *C. glutamicum* are homologous to *C. diphtheriae* nucleic acid and protein molecules, and can therefore be used to detect *C. diphtheriae* in a subject.

The nucleic acid and protein molecules of the invention may also serve as markers for specific regions of the genome. This has utility not only in the mapping of the genome, but also for functional studies of *C. glutamicum* proteins. For example, to identify the region of the genome to which a particular *C. glutamicum* DNA-binding protein binds, the *C. glutamicum* genome could be digested, and the fragments incubated with the DNA-binding protein. Those which bind the protein may be additionally probed with the nucleic acid molecules of the invention, preferably with readily detectable labels; binding of such a nucleic acid molecule to the genome fragment enables the localization of the fragment to the genome map of *C. glutamicum*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related bacteria, such as *Brevibacterium lactofermentum*.

The MP nucleic acid molecules of the invention are also useful for evolutionary and protein structural studies. The metabolic processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Manipulation of the MP nucleic acid molecules of the invention may result in the production of MP proteins having functional differences from the wild-type MP proteins. These proteins may be improved in efficiency or activity, may be present in greater numbers in the cell than is usual, or may be decreased in efficiency or activity.

The invention also provides methods for screening molecules which modulate the activity of an MP protein, either by interacting with the protein itself or a substrate or binding partner of the MP protein, or by modulating the transcription or translation of an MP nucleic acid molecule of the invention. In such methods, a microorganism expressing one or more MP proteins of the invention is contacted with one or more test compounds, and the effect of each test compound on the activity or level of expression of the MP protein is assessed.

When the desired fine chemical to be isolated from large-scale fermentative culture of *C. glutamicum* is an amino acid, a vitamin, a cofactor, a nutraceutical, a nucleotide, a nucleoside, or trehalose, modulation of the activity or efficiency of activity of one or more of the proteins of the invention by recombinant genetic mechanisms may directly impact the production of one of these fine chemicals. For example, in the case of an enzyme in a biosynthetic pathway for a desired amino acid, improvement in efficiency or activity of the enzyme (including the presence of multiple copies of the gene) should lead to an increased production or efficiency of production of that desired amino acid. In the case of an enzyme in a biosynthetic pathway for an amino acid whose synthesis is in competition with the synthesis of a desired amino acid, any decrease in the efficiency or activity of this enzyme (including deletion of the gene) should result in an increase in production or efficiency of production of the desired amino acid, due to decreased competition for intermediate compounds and/or energy. In the case of an enzyme in a degradation pathway for a desired amino acid, any decrease in efficiency or activity of the enzyme should result in a greater yield or efficiency of production of the desired product due to a decrease in its degradation. Lastly, mutagenesis of an enzyme involved in the biosynthesis of a desired amino acid such that this enzyme is no longer is capable of feedback inhibition should result in increased yields or efficiency of production of the desired amino acid. The same should apply to the biosynthetic and degradative enzymes of the invention involved in the metabolism of vitamins, cofactors, nutraceuticals, nucleotides, nucleosides and trehalose.

Similarly, when the desired fine chemical is not one of the aforementioned compounds, the modulation of activity of one of the proteins of the invention may still impact the yield and/or efficiency of production of the compound from large-scale culture of *C. glutamicum*. The metabolic pathways of any organism are closely interconnected; the intermediate used by one pathway is often supplied by a different pathway. Enzyme expression and function may be regulated based on the cellular levels of a compound from a different metabolic process, and the cellular levels of molecules necessary for basic growth, such as amino acids and nucleotides, may critically affect the viability of the microorganism in large-scale culture. Thus, modulation of an amino acid biosynthesis enzyme, for example, such that it is no longer responsive to feedback inhibition or such that it is improved in efficiency or turnover may result in increased cellular levels of one or more amino acids. In turn, this increased pool of amino acids provides not only an increased supply of molecules necessary for protein synthesis, but also of molecules which are utilized as intermediates and precursors in a number of other biosynthetic pathways. If a particular amino acid had been limiting in the cell, its increased production might increase the ability of the cell to perform numerous other metabolic reactions, as well as enabling the cell to more efficiently produce proteins of all kinds, possibly increasing the overall growth rate or survival ability of the cell in large scale culture. Increased viability improves the number of cells capable of producing the desired fine chemical in fermentative culture, thereby increasing the yield of this compound. Similar processes are possible by the modulation of activity of a degradative enzyme of the invention such that the enzyme no longer catalyzes, or catalyzes less efficiently, the degradation of a cellular compound which is important for the biosynthesis of a desired compound, or which will enable the cell to grow and reproduce more efficiently in large-scale culture. It should be emphasized that optimizing the degradative activity or decreasing the biosynthetic activity of certain molecules of the invention may also have a beneficial effect on the production of certain fine chemicals from *C. glutamicum*. For example, by decreasing the efficiency of activity of a biosynthetic enzyme in a pathway which competes with the biosynthetic pathway of a desired compound for one or more intermediates, more of those intermediates should be available for conversion to the desired product. A similar situation may call for the improvement of degradative ability or efficiency of one or more proteins of the invention.

This aforementioned list of mutagenesis strategies for MP proteins to result in increased yields of a desired compound is not meant to be limiting; variations on these mutagenesis strategies will be readily apparent to one of ordinary skill in the art. By these mechanisms, the nucleic acid and protein molecules of the invention may be utilized to generate *C. glutamicum* or related strains of bacteria expressing mutated MP nucleic acid and protein molecules such that the yield, production, and/or efficiency of production of a desired compound is improved. This desired compound may be any natural product of *C. glutamicum*, which includes the final products of biosynthesis pathways and intermediates of naturally-occurring metabolic pathways, as well as molecules which do not naturally occur in the metabolism of *C. glutamicum*, but which are produced by a *C. glutamicum* strain of the invention.

This invention is further illustrated by the following examples which should not be construed as limiting. The contents of all references, patent applications, patents, published patent applications, Tables, Appendices, and the sequence listing cited throughout this application are hereby incorporated by reference.

EXEMPLIFICATION

Example 1

Preparation of Total Genomic DNA of *Corynebacterium glutamicum* ATCC 13032

A culture of *Corynebacterium glutamicum* (ATCC 13032) was grown overnight at 30° C. with vigorous shaking in BHI medium (Difco). The cells were harvested by centrifugation, the supernatant was discarded and the cells were resuspended in 5 ml buffer-I (5% of the original volume of the culture—all indicated volumes have been calculated for 100 ml of culture volume). Composition of buffer-I: 140.34 g/l sucrose, 2.46 g/l $MgSO_4 \times 7H_2O$, 10 ml/l $KH_2PO_4$ solution (100 g/l, adjusted to pH 6.7 with KOH), 50 ml/l M12 concentrate (10 g/l $(NH_4)_2SO_4$, 1 g/l NaCl, 2 g/l $MgSO_4 \times 7H_2O$, 0.2 g/l $CaCl_2$, 0.5 g/l yeast extract (Difco), 10 ml/i trace-elements-mix (200 mg/l $FeSO_4 \times H_2O$, 10 mg/l $ZnSO_4 \times 7H_2O$, 3 mg/l $MnCl_2 \times 4H_2O$, 30 mg/l $H_3BO_3$ 20 mg/l $CoCl_2 \times 6H_2O$, 1 mg/l $NiCl_2 \times 6H_2O$, 3 mg/l $Na_2MoO_4 \times 2H_2O$, 500 mg/l complexing agent (EDTA or critic acid), 100 ml/l vitamins-mix (0.2 mg/l biotin, 0.2 mg/l folic acid, 20 mg/l p-amino benzoic acid, 20 mg/l riboflavin, 40 mg/l α-panthothenate, 140 mg/l nicotinic acid, 40 mg/l pyridoxole hydrochloride, 200 mg/l myo-inositol). Lysozyme was added to the suspension to a final concentration of 2.5 mg/ml. After an approximately 4 h incubation at 37° C., the cell wall was degraded and the resulting protoplasts are harvested by centrifugation. The pellet was washed once with 5 ml buffer-I and once with 5 ml TE-buffer (10 mM Tris-HCl, 1 mM EDTA, pH 8). The pellet was resuspended in 4 ml TE-buffer and 0.5 ml SDS solution (10%) and 0.5 ml NaCl solution (5 M) are added. After adding of proteinase K to a final concentration of 200 µg/ml, the suspension is incubated for ca. 18 h at 37° C. The DNA was purified by extraction with phenol, phenol-chloroform-isoamylalcohol and chloroform-isoamylalcohol using standard procedures. Then, the DNA was precipitated by adding 1/50 volume of 3 M sodium acetate and 2 volumes of ethanol, followed by a 30 min incubation at −20° C. and a 30 min centrifugation at 12,000 rpm in a high speed centrifuge using a SS34 rotor (Sorvall). The DNA was dissolved in 1 ml TE-buffer containing 20 µg/ml RNaseA and dialysed at 4° C. against 1000 ml TE-buffer for at least 3 hours. During this time, the buffer was exchanged 3 times. To aliquots of 0.4 ml of the dialysed DNA solution, 0.4 ml of 2 M LiCl and 0.8 ml of ethanol are added. After a 30 min incubation at −20° C., the DNA was collected by centrifugation (13,000 rpm, Biofuge Fresco, Heraeus, Hanau, Germany). The DNA pellet was dissolved in TE-buffer. DNA prepared by this procedure could be used for all purposes, including southern blotting or construction of genomic libraries.

Example 2

Construction of Genomic Libraries in *Escherichia coli* of *Corynebacterium glutamicum* ATCC13032

Using DNA prepared as described in Example 1, cosmid and plasmid libraries were constructed according to known and well established methods (see e.g., Sambrook, J. et al. (1989) "Molecular Cloning: A Laboratory Manual", Cold Spring Harbor Laboratory Press, or Ausubel, F. M. et al. (1994) "Current Protocols in Molecular Biology", John Wiley & Sons.)

Any plasmid or cosmid could be used. Of particular use were the plasmids pBR322 (Sutcliffe, J. G. (1979) *Proc. Natl. Acad. Sci. USA,* 75:3737-3741); pACYC177 (Change & Cohen (1978) *J. Bacteriol* 134:1141-1156), plasmids of the pBS series (pBSSK+, pBSSK− and others; Stratagene, LaJolla, USA), or cosmids as SuperCos1 (Stratagene, LaJolla, USA) or Lorist6 (Gibson, T. J., Rosenthal A. and Waterson, R. H. (1987) *Gene* 53:283-286. Gene libraries specifically for use in *C. glutamicum* may be constructed using plasmid pSL109 (Lee, H.-S. and A. J. Sinskey (1994) *J. Microbiol. Biotechnol.* 4: 256-263).

Example 3

DNA Sequencing and Computational Functional Analysis

Genomic libraries as described in Example 2 were used for DNA sequencing according to standard methods, in particular by the chain termination method using ABI377 sequencing machines (see e.g., Fleischman, R. D. et al. (1995) "Whole-genome Random Sequencing and Assembly of *Haemophilus Influenzae* Rd., *Science,* 269:496-512). Sequencing primers with the following nucleotide sequences were used: 5'-GGAAACAGTATGACCATG-3' or 5'-GTAAAAC-GACGGCCAGT-3'.

Example 4

In Vivo Mutagenesis

In vivo mutagenesis of *Corynebacterium glutamicum* can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D. (1996) DNA repair mechanisms, in: *Escherichia coli* and *Salmonella*, p. 2277-2294, ASM: Washington.) Such strains are well known to those of ordinary skill in the art. The use of such strains is illustrated, for example, in Greener, A. and Callahan, M. (1994) *Strategies* 7: 32-34.

Example 5

DNA Transfer Between *Escherichia coli* and *Corynebacterium glutamicum*

Several *Corynebacterium* and *Brevibacterium* species contain endogenous plasmids (as e.g., pHM1519 or pBL1) which replicate autonomously (for review see, e.g., Martin, J. F. et al. (1987) *Biotechnology,* 5:137-146). Shuttle vectors for *Escherichia coli* and *Corynebacterium glutamicum* can be readily constructed by using standard vectors for *E. coli* (Sambrook, J. et al. (1989), "Molecular Cloning: A Laboratory Manual", Cold Spring Harbor Laboratory Press or Ausubel, F. M. et al. (1994) "Current Protocols in Molecular Biology", John Wiley & Sons) to which a origin or replication for and a suitable marker from *Corynebacterium glutamicum* is added. Such origins of replication are preferably taken from endogenous plasmids isolated from *Corynebacterium* and *Brevibacterium* species. Of particular use as transformation markers for these species are genes for kanamycin resistance (such as those derived from the Tn5 or Tn903 transposons) or chloramphenicol (Winnacker, E. L. (1987) "From Genes to Clones—Introduction to Gene Technology, VCH, Weinheim). There are numerous examples in the literature of the construction of a wide variety of shuttle vectors which replicate in both *E. coli* and *C. glutamicum*, and which can be used for several purposes, including gene over-expression (for reference, see e.g., Yoshihama, M. et al. (1985) *J. Bacteriol.* 162:591-597, Martin J. F. et al. (1987) *Biotechnology,* 5:137-146 and Eikmanns, B. J. et al. (1991) *Gene,* 102:93-98).

Using standard methods, it is possible to clone a gene of interest into one of the shuttle vectors described above and to introduce such a hybrid vectors into strains of *Corynebacterium glutamicum*. Transformation of *C. glutamicum* can be achieved by protoplast transformation (Kastsumata, R. et al. (1984) *J. Bacteriol.* 159306-311), electroporation (Liebl, E. et al. (1989) *FEMS Microbiol. Letters,* 53:399-303) and in cases where special vectors are used, also by conjugation (as described e.g. in Schäfer, A et al. (1990) *J. Bacteriol.* 172: 1663-1666). It is also possible to transfer the shuttle vectors for *C. glutamicum* to *E. coli* by preparing plasmid DNA from *C. glutamicum* (using standard methods well-known in the art) and transforming it into *E. coli*. This transformation step can be performed using standard methods, but it is advantageous to use an Mcr-deficient *E. coli* strain, such as NM522 (Gough & Murray (1983) *J. Mol. Biol.* 166:1-19).

Genes may be overexpressed in *C. glutamicum* strains using plasmids which comprise pCG1 (U.S. Pat. No. 4,617,267) or fragments thereof, and optionally the gene for kanamycin resistance from TN903 (Grindley, N. D. and Joyce, C. M. (1980) *Proc. Natl. Acad. Sci. USA* 77 (12): 7176-7180). In addition, genes may be overexpressed in *C. glutamicum* strains using plasmid pSL109 (Lee, H.-S. and A. J. Sinskey (1994) *J. Microbiol. Biotechnol.* 4: 256-263).

Aside from the use of replicative plasmids, gene overexpression can also be achieved by integration into the genome. Genomic integration in *C. glutamicum* or other *Corynebacterium* or *Brevibacterium* species may be accomplished by well-known methods, such as homologous recombination with genomic region(s), restriction endonuclease mediated integration (REMI) (see, e.g., DE Patent 19823834), or through the use of transposons. It is also possible to modulate the activity of a gene of interest by modifying the regulatory regions (e.g., a promoter, a repressor, and/or an enhancer) by sequence modification, insertion, or deletion using site-directed methods (such as homologous recombination) or methods based on random events (such as transposon mutagenesis or REMI). Nucleic acid sequences which function as transcriptional terminators may also be inserted 3' to the coding region of one or more genes of the invention; such terminators are well-known in the art and are described, for example, in Winnacker, E. L. (1987) From Genes to Clones—Introduction to Gene Technology. VCH: Weinheim.

Example 6

Assessment of the Expression of the Mutant Protein

Observations of the activity of a mutated protein in a transformed host cell rely on the fact that the mutant protein is expressed in a similar fashion and in a similar quantity to that of the wild-type protein. A useful method to ascertain the level of transcription of the mutant gene (an indicator of the amount of mRNA available for translation to the gene product) is to perform a Northern blot (for reference see, for example, Ausubel et al. (1988) Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information is evidence of the degree of transcription of the mutant gene. Total cellular RNA can be prepared from *Corynebacterium glutamicum* by several methods, all well-known in the art, such as that described in Bormann, E. R. et al. (1992) *Mol. Microbiol.* 6: 317-326.

To assess the presence or relative quantity of protein translated from this mRNA, standard techniques, such as a Western blot, may be employed (see, for example, Ausubel et al.

(1988) Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or colorimetric label which may be readily detected. The presence and quantity of label observed indicates the presence and quantity of the desired mutant protein present in the cell.

Example 7

Growth of Genetically Modified *Corynebacterium glutamicum*—Media and Culture Conditions Genetically modified *Corynebacteria* are cultured in synthetic or natural growth media. A number of different growth media for *Corynebacteria* are both well-known and readily available (Lieb et al. (1989) *Appl. Microbiol. Biotechnol.*, 32:205-210; von der Osten et al. (1998) Biotechnology Letters, 11:11-16; Patent DE 4,120,867; Liebl (1992) "The Genus *Corynebacterium*, in: The Procaryotes, Volume II, Balows, A. et al., eds. Springer-Verlag). These media consist of one or more carbon sources, nitrogen sources, inorganic salts, vitamins and trace elements. Preferred carbon sources are sugars, such as mono-, di-, or polysaccharides. For example, glucose, fructose, mannose, galactose, ribose, sorbose, ribulose, lactose, maltose, sucrose, raffinose, starch or cellulose serve as very good carbon sources. It is also possible to supply sugar to the media via complex compounds such as molasses or other by-products from sugar refinement. It can also be advantageous to supply mixtures of different carbon sources. Other possible carbon sources are alcohols and organic acids, such as methanol, ethanol, acetic acid or lactic acid. Nitrogen sources are usually organic or inorganic nitrogen compounds, or materials which contain these compounds. Exemplary nitrogen sources include ammonia gas or ammonia salts, such as $NH_4Cl$ or $(NH_4)_2SO_4$, $NH_4OH$, nitrates, urea, amino acids or complex nitrogen sources like corn steep liquor, soy bean flour, soy bean protein, yeast extract, meat extract and others.

Inorganic salt compounds which may be included in the media include the chloride-, phosphorous- or sulfate-salts of calcium, magnesium, sodium, cobalt, molybdenum, potassium, manganese, zinc, copper and iron. Chelating compounds can be added to the medium to keep the metal ions in solution. Particularly useful chelating compounds include dihydroxyphenols, like catechol or protocatechuate, or organic acids, such as citric acid. It is typical for the media to also contain other growth factors, such as vitamins or growth promoters, examples of which include biotin, riboflavin, thiamin, folic acid, nicotinic acid, pantothenate and pyridoxin. Growth factors and salts frequently originate from complex media components such as yeast extract, molasses, corn steep liquor and others. The exact composition of the media compounds depends strongly on the immediate experiment and is individually decided for each specific case. Information about media optimization is available in the textbook "Applied Microbiol. Physiology, A Practical Approach (eds. P. M. Rhodes, P. F. Stanbury, IRL Press (1997) pp. 53-73, ISBN 0 19 963577 3). It is also possible to select growth media from commercial suppliers, like standard 1 (Merck) or BHI (grain heart infusion, DIFCO) or others.

All medium components are sterilized, either by heat (20 minutes at 1.5 bar and 121° C.) or by sterile filtration. The components can either be sterilized together or, if necessary, separately. All media components can be present at the beginning of growth, or they can optionally be added continuously or batchwise.

Culture conditions are defined separately for each experiment. The temperature should be in a range between 15° C. and 45° C. The temperature can be kept constant or can be altered during the experiment. The pH of the medium should be in the range of 5 to 8.5, preferably around 7.0, and can be maintained by the addition of buffers to the media. An exemplary buffer for this purpose is a potassium phosphate buffer. Synthetic buffers such as MOPS, HEPES, ACES and others can alternatively or simultaneously be used. It is also possible to maintain a constant culture pH through the addition of NaOH or $NH_4OH$ during growth. If complex medium components such as yeast extract are utilized, the necessity for additional buffers may be reduced, due to the fact that many complex compounds have high buffer capacities. If a fermentor is utilized for culturing the micro-organisms, the pH can also be controlled using gaseous ammonia.

The incubation time is usually in a range from several hours to several days. This time is selected in order to permit the maximal amount of product to accumulate in the broth. The disclosed growth experiments can be carried out in a variety of vessels, such as microtiter plates, glass tubes, glass flasks or glass or metal fermentors of different sizes. For screening a large number of clones, the microorganisms should be cultured in microtiter plates, glass tubes or shake flasks, either with or without baffles. Preferably 100 ml shake flasks are used, filled with 10% (by volume) of the required growth medium. The flasks should be shaken on a rotary shaker (amplitude 25 mm) using a speed-range of 100-300 rpm. Evaporation losses can be diminished by the maintenance of a humid atmosphere; alternatively, a mathematical correction for evaporation losses should be performed.

If genetically modified clones are tested, an unmodified control clone or a control clone containing the basic plasmid without any insert should also be tested. The medium is inoculated to an $OD_{600}$ of 0.5-1.5 using cells grown on agar plates, such as CM plates (10 g/l glucose, 2,5 g/l NaCl, 2 g/l urea, 10 g/l polypeptone, 5 g/l yeast extract, 5 g/l meat extract, 22 g/l NaCl, 2 g/l urea, 10 g/l polypeptone, 5 g/l yeast extract, 5 g/l meat extract, 22 g/l agar, pH 6.8 with 2M NaOH) that had been incubated at 30° C. Inoculation of the media is accomplished by either introduction of a saline suspension of *C. glutamicum* cells from CM plates or addition of a liquid preculture of this bacterium.

Example 8

In Vitro Analysis of the Function of Mutant Proteins

The determination of activities and kinetic parameters of enzymes is well established in the art. Experiments to determine the activity of any given altered enzyme must be tailored to the specific activity of the wild-type enzyme, which is well within the ability of one of ordinary skill in the art. Overviews about enzymes in general, as well as specific details concerning structure, kinetics, principles, methods, applications and examples for the determination of many enzyme activities may be found, for example, in the following references: Dixon, M., and Webb, E. C., (1979) Enzymes. Longmans: London; Fersht, (1985) Enzyme Structure and Mechanism. Freeman: New York; Walsh, (1979) Enzymatic Reaction Mechanisms. Freeman: San Francisco; Price, N. C., Stevens, L. (1982) Fundamentals of Enzymology. Oxford Univ. Press: Oxford; Boyer, P. D., ed. (1983) The Enzymes, $3^{rd}$ ed. Academic Press: New York; Bisswanger, H., (1994) Enzymkinetik, 2$^{nd}$ ed. VCH: Weinheim (ISBN 3527300325); Bergmeyer, H. U., Bergmeyer, J., Graβl, M., eds. (1983-1986) Methods of Enzymatic Analysis, 3$^{rd}$ ed., vol. I-XII, Verlag Chemie: Weinheim; and Ullmann's Encyclopedia of Industrial Chemistry (1987) vol. A9, "Enzymes". VCH: Weinheim, p. 352-363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al. (1995) *EMBO J.* 14: 3895-3904 and references cited therein). Reporter gene test systems are well known and established for applications in both pro- and eukaryotic cells, using enzymes such as beta-galactosidase, green fluorescent protein, and several others.

The determination of activity of membrane-transport proteins can be performed according to techniques such as those described in Gennis, R. B. (1989) "Pores, Channels and Transporters", in Biomembranes, Molecular Structure and Function, Springer: Heidelberg, p. 85-137; 199-234; and 270-322.

Example 9

Analysis of Impact of Mutant Protein on the Production of the Desired Product

The effect of the genetic modification in *C. glutamicum* on production of a desired compound (such as an amino acid) can be assessed by growing the modified microorganism under suitable conditions (such as those described above) and analyzing the medium and/or the cellular component for increased production of the desired product (i.e., an amino acid). Such analysis techniques are well known to one of ordinary skill in the art, and include spectroscopy, thin layer chromatography, staining methods of various kinds, enzymatic and microbiological methods, and analytical chromatography such as high performance liquid chromatography (see, for example, Ullman, Encyclopedia of Industrial Chemistry, vol. A2, p. 89-90 and p. 443-613, VCH: Weinheim (1985); Fallon, A. et al., (1987) "Applications of HPLC in Biochemistry" in: Laboratory Techniques in Biochemistry and Molecular Biology, vol. 17; Rehm et al. (1993) Biotechnology, vol. 3, Chapter III: "Product recovery and purification", page 469-714, VCH: Weinheim; Belter, P. A. et al. (1988) Bioseparations: downstream processing for biotechnology, John Wiley and Sons; Kennedy, J. F. and Cabral, J. M. S. (1992) Recovery processes for biological materials, John Wiley and Sons; Shaeiwitz, J. A. and Henry, J. D. (1988) Biochemical separations, in: Ulmann's Encyclopedia of Industrial Chemistry, vol. B3, Chapter 11, page 1-27, VCH: Weinheim; and Dechow, F. J. (1989) Separation and purification techniques in biotechnology, Noyes Publications.)

In addition to the measurement of the final product of fermentation, it is also possible to analyze other components of the metabolic pathways utilized for the production of the desired compound, such as intermediates and side-products, to determine the overall efficiency of production of the compound. Analysis methods include measurements of nutrient levels in the medium (e.g., sugars, hydrocarbons, nitrogen sources, phosphate, and other ions), measurements of biomass composition and growth, analysis of the production of common metabolites of biosynthetic pathways, and measurement of gasses produced during fermentation. Standard methods for these measurements are outlined in Applied Microbial Physiology, A Practical Approach, P. M. Rhodes and P. F. Stanbury, eds., IRL Press, p. 103-129; 131-163; and 165-192 (ISBN: 0199635773) and references cited therein.

Example 10

Purification of the Desired Product from *C. glutamicum* Culture

Recovery of the desired product from the *C. glutamicum* cells or supernatant of the above-described culture can be performed by various methods well known in the art. If the desired product is not secreted from the cells, the cells can be harvested from the culture by low-speed centrifugation, the cells can be lysed by standard techniques, such as mechanical force or sonication. The cellular debris is removed by centrifugation, and the supernatant fraction containing the soluble proteins is retained for further purification of the desired compound. If the product is secreted from the *C. glutamicum* cells, then the cells are removed from the culture by low-speed centrifugation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One of ordinary skill in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There are a wide array of purification methods known to the art and the preceding method of purification is not meant to be limiting. Such purification techniques are described, for example, in Bailey, J. E. & Ollis, D. F. Biochemical Engineering Fundamentals, McGraw-Hill: New York (1986).

The identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek et al. (1994) *Appl. Environ. Microbiol.* 60:133-140; Malakhova et al. (1996) *Biotekhnologiya* 11: 27-32; and Schmidt et al. (1998) *Bioprocess Engineer.* 19: 67-70. Ulmann's Encyclopedia of Industrial Chemistry, (1996) vol. A27, VCH: Weinheim, p. 89-90, p. 521-540, p. 540-547, p. 559-566, 575-581 and p. 581-587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Example 11

Analysis of the Gene Sequences of the Invention

The comparison of sequences and determination of percent homology between two sequences are art-known techniques, and can be accomplished using a mathematical algorithm, such as the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to MP nucleic acid molecules of the invention. BLAST protein searches can be performed with the XBLAST program, score=50, wordlength=3 to obtain amino acid sequences homologous to MP protein molecules of the invention. To obtain gapped alignments for comparison purposes, Gapped BLAST can be utilized as described in Altschul et al., (1997) *Nucleic Acids Res.* 25 (17):3389-3402. When utilizing BLAST and Gapped BLAST programs, one of ordinary skill in the art will know how to optimize the parameters of the program (e.g., XBLAST and NBLAST) for the specific sequence being analyzed.

Another example of a mathematical algorithm utilized for the comparison of sequences is the algorithm of Meyers and Miller ((1988) *Comput. Appl. Biosci.* 4: 11-17). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art, and include ADVANCE and ADAM. described in Torelli and Robotti (1994) *Comput. Appl. Biosci.* 10:3-5; and FASTA, described in Pearson and Lipman (1988) *P.N.A.S.* 85:2444-8.

The percent homology between two amino acid sequences can also be accomplished using the GAP program in the GCG software package (available at http://www.gcg.com), using either a Blosum 62 matrix or a PAM250 matrix, and a gap weight of 12, 10, 8, 6, or 4 and a length weight of 2, 3, or 4. The percent homology between two nucleic acid sequences can be accomplished using the GAP program in the GCG software package, using standard parameters, such as a gap weight of 50 and a length weight of 3.

A comparative analysis of the gene sequences of the invention with those present in Genbank has been performed using techniques known in the art (see, e.g., Bexevanis and Ouellette, eds. (1998) Bioinformatics: A Practical Guide to the Analysis of Genes and Proteins. John Wiley and Sons: New York). The gene sequences of the invention were compared to genes present in Genbank in a three-step process. In a first step, a BLASTN analysis (e.g., a local alignment analysis) was performed for each of the sequences of the invention against the nucleotide sequences present in Genbank, and the top 500 hits were retained for further analysis. A subsequent FASTA search (e.g., a combined local and global alignment analysis, in which limited regions of the sequences are aligned) was performed on these 500 hits. Each gene sequence of the invention was subsequently globally aligned to each of the top three FASTA hits, using the GAP program in the GCG software package (using standard parameters). In order to obtain correct results, the length of the sequences extracted from Genbank were adjusted to the length of the query sequences by methods well-known in the art. The results of this analysis are set forth in Table 4. The resulting data is identical to that which would have been obtained had a GAP (global) analysis alone been performed on each of the genes of the invention in comparison with each of the references in Genbank, but required significantly reduced computational time as compared to such a database-wide GAP (global) analysis. Sequences of the invention for which no alignments above the cutoff values were obtained are indicated on Table 4 by the absence of alignment information. It will further be understood by one of ordinary skill in the art that the GAP alignment homology percentages set forth in Table 4 under the heading "% homology (GAP)" are listed in the European numerical format, wherein a ',' represents a decimal point. For example, a value of "40,345" in this column represents "40.345%".

Example 12

Construction and Operation of DNA Microarrays

The sequences of the invention may additionally be used in the construction and application of DNA microarrays (the design, methodology, and uses of DNA arrays are well known in the art, and are described, for example, in Schena, M. et al. (1995) *Science* 270: 467-470; Wodicka, L. et al. (1997) *Nature Biotechnology* 15: 1359-1367; DeSaizieu, A. et al. (1998) *Nature Biotechnology* 16: 45-48; and DeRisi, J. L. et al. (1997) *Science* 278: 680-686).

DNA microarrays are solid or flexible supports consisting of nitrocellulose, nylon, glass, silicone, or other materials. Nucleic acid molecules may be attached to the surface in an ordered manner. After appropriate labeling, other nucleic acids or nucleic acid mixtures can be hybridized to the immobilized nucleic acid molecules, and the label may be used to monitor and measure the individual signal intensities of the hybridized molecules at defined regions. This methodology allows the simultaneous quantification of the relative or absolute amount of all or selected nucleic acids in the applied nucleic acid sample or mixture. DNA microarrays, therefore, permit an analysis of the expression of multiple (as many as 6800 or more) nucleic acids in parallel (see, e.g., Schena, M. (1996) *BioEssays* 18 (5): 427-431).

The sequences of the invention may be used to design oligonucleotide primers which are able to amplify defined regions of one or more *C. glutamicum* genes by a nucleic acid amplification reaction such as the polymerase chain reaction. The choice and design of the 5' or 3' oligonucleotide primers or of appropriate linkers allows the covalent attachment of the resulting PCR products to the surface of a support medium described above (and also described, for example, Schena, M. et al. (1995) *Science* 270: 467-470).

Nucleic acid microarrays may also be constructed by in situ oligonucleotide synthesis as described by Wodicka, L. et al. (1997) *Nature Biotechnology* 15: 1359-1367. By photolithographic methods, precisely defined regions of the matrix are exposed to light. Protective groups which are photolabile are thereby activated and undergo nucleotide addition, whereas regions that are masked from light do not undergo any modification. Subsequent cycles of protection and light activation permit the synthesis of different oligonucleotides at defined positions. Small, defined regions of the genes of the invention may be synthesized on microarrays by solid phase oligonucleotide synthesis.

The nucleic acid molecules of the invention present in a sample or mixture of nucleotides may be hybridized to the microarrays. These nucleic acid molecules can be labeled according to standard methods. In brief, nucleic acid molecules (e.g., mRNA molecules or DNA molecules) are labeled by the incorporation of isotopically or fluorescently labeled nucleotides, e.g., during reverse transcription or DNA synthesis. Hybridization of labeled nucleic acids to microarrays is described (e.g., in Schena, M. et al. (1995) supra; Wodicka, L. et al. (1997), supra; and DeSaizieu A. et al. (1998), supra). The detection and quantification of the hybridized molecule are tailored to the specific incorporated label. Radioactive labels can be detected, for example, as described in Schena, M. et al. (1995) supra) and fluorescent labels may be detected, for example, by the method of Shalon et al. (1996) *Genome Research* 6: 639-645).

The application of the sequences of the invention to DNA microarray technology, as described above, permits comparative analyses of different strains of *C. glutamicum* or other *Corynebacteria*. For example, studies of inter-strain variations based on individual transcript profiles and the identification of genes that are important for specific and/or desired strain properties such as pathogenicity, productivity and stress tolerance are facilitated by nucleic acid array methodologies. Also, comparisons of the profile of expression of genes of the invention during the course of a fermentation reaction are possible using nucleic acid array technology.

Example 13

Analysis of the Dynamics of Cellular Protein Populations (Proteomics)

The genes, compositions, and methods of the invention may be applied to study the interactions and dynamics of populations of proteins, termed 'proteomics'. Protein populations of interest include, but are not limited to, the total protein population of *C. glutamicum* (e.g., in comparison with the protein populations of other organisms), those proteins which are active under specific environmental or metabolic conditions (e.g., during fermentation, at high or low temperature, or at high or low pH), or those proteins which are active during specific phases of growth and development.

Protein populations can be analyzed by various well-known techniques, such as gel electrophoresis. Cellular proteins may be obtained, for example, by lysis or extraction, and may be separated from one another using a variety of electrophoretic techniques. Sodium dodecyl sulfate polyacrylamide gel electrophoresis (SDS-PAGE) separates proteins largely on the basis of their molecular weight. Isoelectric focusing polyacrylamide gel electrophoresis (IEF-PAGE) separates proteins by their isoelectric point (which reflects not only the amino acid sequence but also posttranslational modifications of the protein). Another, more preferred method of protein analysis is the consecutive combination of both IEF-PAGE and SDS-PAGE, known as 2-D-gel electrophoresis (described, for example, in Hermann et al. (1998) *Electrophoresis* 19: 3217-3221; Fountoulakis et al. (1998) *Electrophoresis* 19: 1193-1202; Langen et al. (1997) *Electrophoresis* 18: 1184-1192; Antelmann et al. (1997) *Electrophoresis* 18: 1451-1463). Other separation techniques may also be utilized for protein separation, such as capillary gel electrophoresis; such techniques are well known in the art.

Proteins separated by these methodologies can be visualized by standard techniques, such as by staining or labeling. Suitable stains are known in the art, and include Coomassie Brilliant Blue, silver stain, or fluorescent dyes such as Sypro Ruby (Molecular Probes). The inclusion of radioactively labeled amino acids or other protein precursors (e.g., $^{35}$S-methionine, $^{35}$S-cysteine, $^{14}$C-labelled amino acids, $^{15}$N-amino acids, $^{15}$NO$_3$ or $^{15}$NH$_4^+$ or $^{13}$C-labelled amino acids) in the medium of *C. glutamicum* permits the labeling of proteins from these cells prior to their separation. Similarly, fluorescent labels may be employed. These labeled proteins can be extracted, isolated and separated according to the previously described techniques.

Proteins visualized by these techniques can be further analyzed by measuring the amount of dye or label used. The amount of a given protein can be determined quantitatively using, for example, optical methods and can be compared to the amount of other proteins in the same gel or in other gels. Comparisons of proteins on gels can be made, for example, by optical comparison, by spectroscopy, by image scanning and analysis of gels, or through the use of photographic films and screens. Such techniques are well-known in the art.

To determine the identity of any given protein, direct sequencing or other standard techniques may be employed. For example, N- and/or C-terminal amino acid sequencing (such as Edman degradation) may be used, as may mass spectrometry (in particular MALDI or ESI techniques (see, e.g., Langen et al. (1997) *Electrophoresis* 18: 1184-1192)). The protein sequences provided herein can be used for the identification of *C. glutamicum* proteins by these techniques.

The information obtained by these methods can be used to compare patterns of protein presence, activity, or modification between different samples from various biological conditions (e.g., different organisms, time points of fermentation, media conditions, or different biotopes, among others). Data obtained from such experiments alone, or in combination with other techniques, can be used for various applications, such as to compare the behavior of various organisms in a given (e.g., metabolic) situation, to increase the productivity of strains which produce fine chemicals or to increase the efficiency of the production of fine chemicals.

Equivalents

Those of ordinary skill in the art will recognize, or will be able to ascertain using no more than routine experimentation, many equivalents to the specific embodiments of the invention described herein. Such equivalents are intended to be encompassed by the following claims.

TABLE 1

Included Genes

| Nucleic Acid SEQ ID NO | Amino Acid SEQ ID NO | Identification Code | Contig. | NT Start | NT Stop | Function |
|---|---|---|---|---|---|---|
| | | | | | | Lysine biosynthesis |
| 1 | 2 | RXA02229 | GR00653 | 2793 | 3617 | DIAMINOPIMELATE EPIMERASE (EC 5.1.1.7) |
| 3 | 4 | RXS02970 | | | | ACETYLORNITHINE AMINOTRANSFERASE (EC 2.6.1.11) |
| 5 | 6 | F RXA01009 | GR00287 | 4714 | 5943 | ACETYLORNITHINE AMINOTRANSFERASE (EC 2.6.1.11) |
| 7 | 8 | RXC02390 | | | | MEMBRANE SPANNING PROTEIN INVOLVED IN LYSINE METABOLISM |
| 9 | 10 | RXC01796 | | | | MEMBRANE ASSOCIATED PROTEIN INVOLVED IN LYSINE METABOLISM |
| 11 | 12 | RXC01207 | | | | CYTOSOLIC PROTEIN INVOLVED IN METABOLISM OF LYSINE AND THREONINE |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 13 | 14 | RXC00657 | | | | TRANSCRIPTIONAL REGULATOR INVOLVED IN LYSINE METABOLISM |
| 15 | 16 | RXC00552 | | | | CYTOSOLIC PROTEIN INVOLVED IN LYSINE METABOLISM |
| | | | | | | Trehalose |
| 17 | 18 | RXN00351 | VV0135 | 37078 | 38532 | ALPHA,ALPHA-TREHALOSE-PHOSPHATE SYNTHASE (UDP-FORMING) 56 KD SUBUNIT (EC 2.4.1.15) |
| 19 | 20 | F RXA00351 | GR00066 | 1486 | 2931 | ALPHA,ALPHA-TREHALOSE-PHOSPHATE SYNTHASE (UDP-FORMING) 56 KD SUBUNIT (EC 2.4.1.15) |
| 21 | 22 | RXA00873 | GR00241 | 3 | 758 | trehalose synthase (EC 2.4.1.-) |
| 23 | 24 | RXA00891 | GR00243 | 1005 | 4 | trehalose synthase (EC 2.4.1.-) |
| | | | | | | Lysine biosynthesis |
| 25 | 26 | RXA00534 | GR00137 | 4758 | 3496 | ASPARTOKINASE ALPHA AND BETA SUBUNITS (EC 2.7.2.4) |
| 27 | 28 | RXA00533 | GR00137 | 3469 | 2438 | ASPARTATE-SEMIALDEHYDE DEHYDROGENASE (EC 1.2.1.11) |
| 29 | 30 | RXA02843 | GR00842 | 543 | 4 | 2,3,4,5-TETRAHYDROPYRIDINE-2-CARBOXYLATE N-SUCCINYLTRANSFERASE (EC 2.3.1.117) |
| 31 | 32 | RXA02022 | GR00613 | 2063 | 3169 | SUCCINYL-DIAMINOPIMELATE DESUCCINYLASE (EC 3.5.1.18) |
| 33 | 34 | RXA00044 | GR00007 | 3458 | 4393 | DIHYDRODIPICOLINATE SYNTHASE (EC 4.2.1.52) |
| 35 | 36 | RXA00863 | GR00236 | 896 | 1639 | DIHYDRODIPICOLINATE REDUCTASE (EC 1.3.1.26) |
| 37 | 38 | RXA00864 | GR00236 | 1694 | 2443 | probable 2,3-dihydrodipicolinate N-C6-lyase (cyclizing) (EC 4.3.3.-) - Corynebacterium glutamicum |
| 39 | 40 | RXA02843 | GR00842 | 543 | 4 | 2,3,4,5-TETRAHYDROPYRIDINE-2-CARBOXYLATE N-SUCCINYLTRANSFERASE (EC 2.3.1.117) |
| 41 | 42 | RXN00355 | VV0135 | 31980 | 30961 | MESO-DIAMINOPIMELATE D-DEHYDROGENASE |
| 43 | 44 | F RXA00352 | GR00068 | 861 | 4 | MESO-DIAMINOPIMELATE D-DEHYDROGENASE (EC 1.4.1.16) |
| 45 | 46 | RXA00972 | GR00274 | 3 | 1379 | DIAMINOPIMELATE DECARBOXYLASE (EC 4.1.1.20) |
| 47 | 48 | RXA02653 | GR00752 | 5237 | 7234 | DIAMINOPIMELATE DECARBOXYLASE (EC 4.1.1.20) |
| 49 | 50 | RXA01393 | GR00408 | 4249 | 3380 | LYSINE EXPORT REGULATOR PROTEIN |
| 51 | 52 | RXA00241 | GR00036 | 5443 | 6945 | L-LYSINE TRANSPORT PROTEIN |
| 53 | 54 | RXA01394 | GR00408 | 4320 | 5018 | LYSINE EXPORTER PROTEIN |
| 55 | 56 | RXA00865 | GR00236 | 2647 | 3549 | DIHYDRODIPICOLINATE SYNTHASE (EC 4.2.1.52) |
| 57 | 58 | RXS02021 | | | | 2,3,4,5-TETRAHYDROPYRIDINE-2-CARBOXYLATE N-SUCCINYLTRANSFERASE (EC 2.3.1.117) |
| 59 | 60 | RXS02157 | | | | ACETYLORNITHINE AMINOTRANSFERASE (EC 2.6.1.11) |
| 61 | 62 | RXC00733 | | | | ABC TRANSPORTER ATP-BINDING PROTEIN INVOLVED IN LYSINE METABOLISM |
| 63 | 64 | RXC00861 | | | | PROTEIN INVOLVED IN LYSINE METABOLISM |
| 65 | 66 | RXC00866 | | | | ZN-DEPENDENT HYDROLASE INVOLVED IN LYSINE METABOLISM |
| 67 | 68 | RXC02095 | | | | ABC TRANSPORTER ATP-BINDING PROTEIN INVOLVED IN LYSINE METABOLISM |
| 69 | 70 | RXC03185 | | | | PROTEIN INVOLVED IN LYSINE METABOLISM |
| | | | | | | Glutamate and glutamine metabolism |
| 71 | 72 | RXN00367 | VV0196 | 9744 | 14273 | GLUTAMATE SYNTHASE [NADH] PRECURSOR (EC 1.4.1.14) |
| 73 | 74 | F RXA00007 | GR00001 | 7107 | 8912 | GLUTAMATE SYNTHASE (NADPH) LARGE CHAIN PRECURSOR (EC 1.4.1.13) |
| 75 | 76 | F RXA00364 | GR00074 | 1296 | 4 | GLUTAMATE SYNTHASE (NADPH) LARGE CHAIN PRECURSOR (EC 1.4.1.13) |
| 77 | 78 | F RXA00367 | GR00075 | 1806 | 964 | GLUTAMATE SYNTHASE (NADPH) LARGE CHAIN PRECURSOR (EC 1.4.1.13) |
| 79 | 80 | RXN00076 | VV0154 | 2752 | 4122 | GLUTAMATE SYNTHASE (NADPH) SMALL CHAIN (EC 1.4.1.13) |
| 81 | 82 | F RXA00075 | GR00012 | 2757 | 3419 | GLUTAMATE SYNTHASE (NADPH) SMALL CHAIN (EC 1.4.1.13) |
| 83 | 84 | RXN00198 | VV0181 | 7916 | 7368 | GLUTAMATE SYNTHASE (NADPH) SMALL CHAIN (EC 1.4.1.13) |
| 85 | 86 | F RXA00198 | GR00031 | 2 | 283 | GLUTAMATE SYNTHASE (NADPH) SMALL CHAIN (EC 1.4.1.13) |
| 87 | 88 | RXN00365 | VV0196 | 14607 | 15233 | GLUTAMATE SYNTHASE [NADPH] SMALL CHAIN (EC 1.4.1.13) |
| 89 | 90 | F RXA00365 | GR00075 | 630 | 4 | GLUTAMATE SYNTHASE (NADPH) SMALL CHAIN (EC 1.4.1.13) |
| 91 | 92 | RXA00366 | GR00075 | 961 | 605 | GLUTAMATE SYNTHASE (NADPH) SMALL CHAIN (EC 1.4.1.13) |
| 93 | 94 | RXA02072 | GR00628 | 1259 | 2599 | NADP-SPECIFIC GLUTAMATE DEHYDROGENASE (EC 1.4.1.4) |
| 95 | 96 | RXA00323 | GR00057 | 3855 | 5192 | GLUTAMINE SYNTHETASE (EC 6.3.1.2) |
| 97 | 98 | RXA00335 | GR00057 | 19180 | 17750 | GLUTAMINE SYNTHETASE (EC 6.3.1.2) |
| 99 | 100 | RXA00324 | GR00057 | 5262 | 8396 | GLUTAMATE-AMMONIA-LIGASE ADENYLYLTRANSFERASE (EC 2.7.7.42) |
| 101 | 102 | RXN03176 | VV0332 | 2 | 862 | GLUTAMINASE (EC 3.5.1.2) |
| 103 | 104 | F RXA02879 | GR10017 | 2 | 862 | GLUTAMINASE (EC 3.5.1.2) |
| 105 | 106 | RXA00278 | GR00043 | 2612 | 1581 | GLUTAMINE-BINDING PROTEIN PRECURSOR |
| 107 | 108 | RXA00727 | GR00193 | 614 | 1525 | GLUTAMINE-BINDING PERIPLASMIC PROTEIN PRECURSOR |
| | | | | | | Alanine and Aspartate and Asparagine metabolism |
| 109 | 110 | RXA02139 | GR00639 | 6739 | 4901 | ASPARAGINE SYNTHETASE (GLUTAMINE-HYDROLYZING) (EC 6.3.5.4) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 111 | 112 | RXN00116 | VV0100 | 26974 | 25814 | ASPARTATE AMINOTRANSFERASE (EC 2.6.1.1) |
| 113 | 114 | F RXA00116 | GR00018 | 510 | 4 | ASPARTATE AMINOTRANSFERASE (EC 2.6.1.1) |
| 115 | 116 | RXN00618 | VV0135 | 10288 | 9182 | ASPARTATE AMINOTRANSFERASE (EC 2.6.1.1) |
| 117 | 118 | F RXA00618 | GR00163 | 213 | 746 | ASPARTATE AMINOTRANSFERASE (EC 2.6.1.1) |
| 119 | 120 | F RXA00627 | GR00164 | 854 | 1138 | ASPARTATE AMINOTRANSFERASE (EC 2.6.1.1) |
| 121 | 122 | RXA02550 | GR00729 | 1585 | 275 | ASPARTATE AMINOTRANSFERASE (EC 2.6.1.1) |
| 123 | 124 | RXA02193 | GR00645 | 1942 | 365 | ASPARTATE AMMONIA-LYASE (EC 4.3.1.1) |
| 125 | 126 | RXA02432 | GR00708 | 2669 | 1695 | L-ASPARAGINASE (EC 3.5.1.1) |
| 127 | 128 | RXN03003 | VV0138 | 680 | 6 | ASPARTATE AMINOTRANSFERASE (EC 2.6.1.1) |
| 129 | 130 | RXN00508 | VV0086 | 4701 | 5783 | ALANINE RACEMASE (EC 5.1.1.1) |
| 131 | 132 | RXN00636 | VV0135 | 20972 | 19944 | ALANINE RACEMASE, BIOSYNTHETIC (EC 5.1.1.1) |
| | | | | | | beta-Alanine metabolism |
| 133 | 134 | RXA02536 | GR00726 | 8581 | 7826 | BETA-UREIDOPROPIONASE (EC 3.5.1.6) |
| 135 | 136 | RXS00870 | | | | METHYLMALONATE-SEMIALDEHYDE DEHYDROGENASE (ACYLATING) (EC 1.2.1.27) |
| 137 | 138 | RXS02299 | | | | ASPARTATE 1-DECARBOXYLASE PRECURSOR (EC 4.1.1.11) |
| | | | | | | Glycine and serine metabolism |
| 139 | 140 | RXA01561 | GR00435 | 1113 | 2042 | L-SERINE DEHYDRATASE (EC 4.2.1.13) |
| 141 | 142 | RXA01850 | GR00525 | 481 | 1827 | L-SERINE DEHYDRATASE (EC 4.2.1.13) |
| 143 | 144 | RXA00580 | GR00156 | 7343 | 6042 | SERINE HYDROXYMETHYLTRANSFERASE (EC 2.1.2.1) |
| 145 | 146 | RXA01821 | GR00515 | 10253 | 9876 | SARCOSINE OXIDASE (EC 1.5.3.1) |
| 147 | 148 | RXN02263 | VV0202 | 11783 | 12160 | SARCOSINE OXIDASE (EC 1.5.3.1) |
| 149 | 150 | F RXA02263 | GR00654 | 33454 | 33813 | SARCOSINE OXIDASE (EC 1.5.3.1) |
| 151 | 152 | RXA02176 | GR00641 | 11454 | 12581 | PHOSPHOSERINE AMINOTRANSFERASE (EC 2.6.1.52) |
| 153 | 154 | RXN02758 | GR00766 | 5082 | 4648 | PHOSPHOSERINE PHOSPHATASE (EC 3.1.3.3) |
| 155 | 156 | F RXA02479 | GR00717 | 393 | 4 | PHOSPHOSERINE PHOSPHATASE (EC 3.1.3.3) |
| 157 | 158 | F RXA02758 | GR00766 | 5082 | 4648 | PHOSPHOSERINE PHOSPHATASE (EC 3.1.3.3) |
| 159 | 160 | F RXA02759 | GR00766 | 5330 | 5220 | PHOSPHOSERINE PHOSPHATASE (EC 3.1.3.3) |
| 161 | 162 | RXA02501 | GR00720 | 15041 | 13977 | PHOSPHOSERINE PHOSPHATASE (EC 3.1.3.3) |
| 163 | 164 | RXN03105 | VV0074 | 15857 | 15423 | SARCOSINE OXIDASE (EC 1.5.3.1) |
| 165 | 166 | RXS01130 | | | | D-3-PHOSPHOGLYCERATE DEHYDROGENASE (EC 1.1.1.95) |
| 167 | 168 | RXS03112 | | | | D-3-PHOSPHOGLYCERATE DEHYDROGENASE (EC 1.1.1.95) |
| | | | | | | Threonine metabolism |
| 169 | 170 | RXN00969 | VV0149 | 12053 | 13387 | HOMOSERINE DEHYDROGENASE (EC 1.1.1.3) |
| 171 | 172 | F RXA00974 | GR00274 | 2623 | 3015 | HOMOSERINE DEHYDROGENASE (EC 1.1.1.3) |
| 173 | 174 | RXA00970 | GR00273 | 161 | 1087 | HOMOSERINE KINASE (EC 2.7.1.39) |
| 175 | 176 | RXA00330 | GR00057 | 12968 | 14410 | THREONINE SYNTHASE (EC 4.2.99.2) |
| 177 | 178 | RXN00403 | VV0086 | 70041 | 68911 | HOMOSERINE O-ACETYLTRANSFERASE |
| 179 | 180 | F RXA00403 | GR00088 | 723 | 1832 | HOMOSERINE O-ACETYLTRANSFERASE (EC 2.3.1.11) |
| 181 | 182 | RXC01207 | | | | CYTOSOLIC PROTEIN INVOLVED IN METABOLISM OF LYSINE AND THREONINE |
| 183 | 184 | RXC00152 | | | | MEMBRANE ASSOCIATED PROTEIN INVOLVED IN THREONINE METABOLISM |
| | | | | | | Metabolism of methionine and S-adenosyl methionine |
| 185 | 186 | RXA00115 | GR00017 | 5359 | 4313 | HOMOSERINE O-ACETYLTRANSFERASE (EC 2.3.1.31) |
| 187 | 188 | RXN00403 | VV0086 | 70041 | 68911 | HOMOSERINE O-ACETYLTRANSFERASE |
| 189 | 190 | F RXA00403 | GR00088 | 723 | 1832 | HOMOSERINE O-ACETYLTRANSFERASE (EC 2.3.1.11) |
| 191 | 192 | RXS03158 | | | | CYSTATHIONINE GAMMA-SYNTHASE (EC 4.2.99.9) |
| 193 | 194 | F RXA00254 | GR00038 | 2404 | 1811 | CYSTATHIONINE GAMMA-SYNTHASE (EC 4.2.99.9) |
| 195 | 196 | RXA02532 | GR00726 | 3085 | 2039 | CYSTATHIONINE GAMMA-SYNTHASE (EC 4.2.99.9) |
| 197 | 198 | RXS03159 | | | | CYSTATHIONINE GAMMA-SYNTHASE (EC 4.2.99.9) |
| 199 | 200 | F RXA02768 | GR00770 | 1919 | 2521 | CYSTATHIONINE GAMMA-SYNTHASE (EC 4.2.99.9) |
| 201 | 202 | RXA00216 | GR00032 | 16286 | 15297 | 5-methyltetrahydrofolate-homocysteine methyltransferase (methionine synthetase) |
| 203 | 204 | RXN00402 | VV0086 | 70787 | 70188 | O-ACETYLHOMOSERINE SULFHYDRYLASE (EC 4.2.99.10)/O-ACETYLSERINE SULFHYDRYLASE (EC 4.2.99.8) |
| 205 | 206 | F RXA00402 | GR00088 | 1 | 576 | O-ACETYLHOMOSERINE SULFHYDRYLASE (EC 4.2.99.10)/O-ACETYLSERINE SULFHYDRYLASE (EC 4.2.99.8) |
| 207 | 208 | RXA00405 | GR00089 | 3289 | 3801 | O-ACETYLHOMOSERINE SULFHYDRYLASE (EC 4.2.99.10)/O-ACETYLSERINE SULFHYDRYLASE (EC 4.2.99.8) |
| 209 | 210 | RXA02197 | GR00645 | 4552 | 4025 | 5-METHYLTETRAHYDROFOLATE-HOMOCYSTEINE METHYLTRANSFERASE (EC 2.1.1.13) |
| 211 | 212 | RXN02198 | VV0302 | 9228 | 11726 | 5-METHYLTETRAHYDROFOLATE-HOMOCYSTEINE METHYLTRANSFERASE (EC 2.1.1.13) |
| 213 | 214 | F RXA02198 | GR00646 | 2483 | 6 | 5-METHYLTETRAHYDROFOLATE-HOMOCYSTEINE METHYLTRANSFERASE (EC 2.1.1.13) |
| 215 | 216 | RXN03074 | VV0042 | 2238 | 1741 | S-ADENOSYLMETHIONINE: 2-DEMETHYLMENAQUINONE METHYLTRANSFERASE (EC 2.1.-.-) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 217 | 218 | F RXA02906 | GR10044 | 1142 | 645 | S-ADENOSYLMETHIONINE: 2-DEMETHYLMENAQUINONE METHYLTRANSFERASE (EC 2.1.-.-) |
| 219 | 220 | RXN00132 | VV0124 | 3612 | 5045 | ADENOSYLHOMOCYSTEINASE (EC 3.3.1.1) |
| 221 | 222 | F RXA00132 | GR00020 | 7728 | 7624 | ADENOSYLHOMOCYSTEINASE (EC 3.3.1.1) |
| 223 | 224 | F RXA01371 | GR00398 | 2339 | 3634 | ADENOSYLHOMOCYSTEINASE (EC 3.3.1.1) |
| 225 | 226 | RXN02085 | | | | 5-METHYLTETRAHYDROPTEROYLTRIGLUTAMATE-HOMOCYSTEINE METHYLTRANSFERASE (EC 2.1.1.14) |
| 227 | 228 | F RXA02085 | GR00629 | 3496 | 5295 | 5-METHYLTETRAHYDROPTEROYLTRIGLUTAMATE-HOMOCYSTEINE METHYLTRANSFERASE (EC 2.1.1.14) |
| 229 | 230 | F RXA02086 | GR00629 | 5252 | 5731 | 5-METHYLTETRAHYDROPTEROYLTRIGLUTAMATE-HOMOCYSTEINE METHYLTRANSFERASE (EC 2.1.1.14) |
| 231 | 232 | RXN02648 | | | | 5-METHYLTETRAHYDROPTEROYLTRIGLUTAMATE-HOMOCYSTEINE METHYLTRANSFERASE (EC 2.1.1.14) |
| 233 | 234 | F RXA02648 | GR00751 | 5254 | 4730 | 5-METHYLTETRAHYDROPTEROYLTRIGLUTAMATE-HOMOCYSTEINE METHYLTRANSFERASE (EC 2.1.1.14) |
| 235 | 236 | F RXA02658 | GR00752 | 14764 | 15447 | 5-METHYLTETRAHYDROPTEROYLTRIGLUTAMATE-HOMOCYSTEINE METHYLTRANSFERASE (EC 2.1.1.14) |
| 237 | 238 | RXC02238 | | | | PROTEIN INVOLVED IN METABOLISM OF S-ADENOSYLMETHIONINE, PURINES AND PANTOTHENATE |
| 239 | 240 | RXC00128 | | | | EXPORTED PROTEIN INVOLVED IN METABOLISM OF PYRIDIMES AND ADENOSYLHOMOCYSTEINE |
| S-adenosyl methionine (SAM) Biosynthesis | | | | | | |
| 241 | 242 | RXA02240 | GR00654 | 7160 | 8380 | S-ADENOSYLMETHIONINE SYNTHETASE (EC 2.5.1.6) |
| Cysteine metabolism | | | | | | |
| 243 | 244 | RXA00780 | GR00206 | 1689 | 2234 | SERINE ACETYLTRANSFERASE (EC 2.3.1.30) |
| 245 | 246 | RXA00779 | GR00206 | 550 | 1482 | CYSTEINE SYNTHASE (EC 4.2.99.8) |
| 247 | 248 | RXN00402 | VV0086 | 70787 | 70188 | O-ACETYLHOMOSERINE SULFHYDRYLASE (EC 4.2.99.10)/O-ACETYLSERINE SULFHYDRYLASE (EC 4.2.99.8) |
| 249 | 250 | F RXA00402 | GR00088 | 1 | 576 | O-ACETYLHOMOSERINE SULFHYDRYLASE (EC 4.2.99.10)/O-ACETYLSERINE SULFHYDRYLASE (EC 4.2.99.8) |
| 251 | 252 | RXS00405 | | | | O-ACETYLHOMOSERINE SULFHYDRYLASE (EC 4.2.99.10)/O-ACETYLSERINE SULFHYDRYLASE (EC 4.2.99.8) |
| 253 | 254 | RXC00164 | | | | ABC TRANSPORTER ATP-BINDING PROTEIN INVOLVED IN CYSTEINE METABOLISM |
| 255 | 256 | RXC01191 | | | | ABC TRANSPORTER ATP-BINDING PROTEIN INVOLVED IN CYSTEINE METABOLISM |
| Valine, leucine and isoleucine | | | | | | |
| 257 | 258 | RXA02646 | GR00751 | 3856 | 2588 | THREONINE DEHYDRATASE BIOSYNTHETIC (EC 4.2.1.16) |
| 259 | 260 | RXA00766 | GR00204 | 5091 | 4249 | BRANCHED-CHAIN AMINO ACID AMINOTRANSFERASE (EC 2.6.1.42) |
| 261 | 262 | RXN01690 | VV0246 | 1296 | 196 | BRANCHED-CHAIN AMINO ACID AMINOTRANSFERASE (EC 2.6.1.42) |
| 263 | 264 | F RXA01690 | GR00473 | 1248 | 196 | BRANCHED-CHAIN AMINO ACID AMINOTRANSFERASE (EC 2.6.1.42) |
| 265 | 266 | RXN01026 | VV0143 | 9171 | 7513 | 3-ISOPROPYLMALATE DEHYDRATASE LARGE SUBUNIT (EC 4.2.1.33) |
| 267 | 268 | F RXA01026 | GR00294 | 1 | 1602 | 3-ISOPROPYLMALATE DEHYDRATASE LARGE SUBUNIT (EC 4.2.1.33) |
| 269 | 270 | RXN01127 | VV0157 | 4491 | 3472 | 3-ISOPROPYLMALATE DEHYDROGENASE (EC 1.1.1.85) |
| 271 | 272 | F RXA01132 | GR00315 | 1349 | 1651 | 3-ISOPROPYLMALATE DEHYDROGENASE (EC 1.1.1.85) |
| 273 | 274 | RXN00536 | VV0219 | 6128 | 7498 | 2-ISOPROPYLMALATE SYNTHASE (EC 4.1.3.12) |
| 275 | 276 | F RXA00536 | GR00137 | 6128 | 7360 | 2-ISOPROPYLMALATE SYNTHASE (EC 4.1.3.1) |
| 277 | 278 | RXN02965 | VV0143 | 7711 | 7121 | 3-ISOPROPYLMALATE DEHYDRATASE SMALL SUBUNIT (EC 4.2.1.33) |
| 279 | 280 | RXN01929 | VV0127 | 47590 | 48402 | 3-METHYL-2-OXOBUTANOATE HYDROXYMETHYLTRANSFERASE (EC 2.1.2.11)/DECARBOXYLASE (EC 4.1.1.44) |
| 281 | 282 | F RXA01929 | GR00555 | 2766 | 1960 | 3-METHYL-2-OXOBUTANOATE HYDROXYMETHYLTRANSFERASE (EC 2.1.2.11) |
| 283 | 284 | RXN01420 | VV0122 | 15584 | 14643 | 4''-MYCAROSYL ISOVALERYL-COA TRANSFERASE (EC 2.-.-.-) |
| 285 | 286 | RXS01145 | | | | KETOL-ACID REDUCTOISOMERASE (EC 1.1.1.86) |
| 287 | 288 | F RXA01145 | GR00321 | 1075 | 1530 | KETOL-ACID REDUCTOISOMERASE (EC 1.1.1.86) |
| Arginine and proline metabolism | | | | | | |
| Enzymes of proline biosynthesis: | | | | | | |
| 289 | 290 | RXA02375 | GR00689 | 1449 | 223 | GLUTAMATE 5-KINASE (EC 2.7.2.11) |
| 291 | 292 | RXN02382 | VV0213 | 5162 | 3867 | GAMMA-GLUTAMYL PHOSPHATE REDUCTASE (GPR) (EC 1.2.1.41) |
| 293 | 294 | F RXA02378 | GR00690 | 624 | 16 | GAMMA-GLUTAMYL PHOSPHATE REDUCTASE (GPR) (EC 1.2.1.41) |
| 295 | 296 | F RXA02382 | GR00691 | 2493 | 1894 | GAMMA-GLUTAMYL PHOSPHATE REDUCTASE (GPR) (EC 1.2.1.41) |
| 297 | 298 | RXA02499 | GR00720 | 11883 | 12692 | PYRROLINE-5-CARBOXYLATE REDUCTASE (EC 1.5.1.2) |
| 299 | 300 | RXS02157 | | | | ACETYLORNITHINE AMINOTRANSFERASE (EC 2.6.1.11) |
| 301 | 302 | RXS02262 | | | | ORNITHINE CYCLODEAMINASE (EC 4.3.1.12) |
| 303 | 304 | RXS02970 | | | | ACETYLORNITHINE AMINOTRANSFERASE (EC 2.6.1.11) |
| 305 | 306 | F RXA01009 | GR00287 | 4714 | 5943 | ACETYLORNITHINE AMINOTRANSFERASE (EC 2.6.1.11) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| | | | | | | Enzymes of proline degradation: |
| 307 | 308 | RXN00023 | VV0127 | 68158 | 64703 | PROLINE DEHYDROGENASE (EC 1.5.99.8)/DELTA-1-PYRROLINE-5-CARBOXYLATE DEHYDROGENASE (EC 1.5.1.12) |
| 309 | 310 | F RXA00023 | GR00003 | 2 | 454 | PROLINE DEHYDROGENASE (EC 1.5.99.8)/DELTA-1-PYRROLINE-5-CARBOXYLATE DEHYDROGENASE (EC 1.5.1.12) |
| 311 | 312 | F RXA02284 | GR00660 | 3028 | 5 | PROLINE DEHYDROGENASE (EC 1.5.99.8)/DELTA-1-PYRROLINE-5-CARBOXYLATE DEHYDROGENASE (EC 1.5.1.12) |
| 313 | 314 | RXC02498 | | | | PROTEIN INVOLVED IN PROLINE METABOLISM |
| | | | | | | Synthesis of 3 Hydoxy-proline: |
| 315 | 316 | RXA01491 | GR00423 | 5337 | 4687 | DNA FOR L-PROLINE 3-HYDROXYLASE, COMPLETE CDS |
| | | | | | | Enzymes of ornithine, arginine and spermidine metabolism: |
| 317 | 318 | RXA02155 | GR00640 | 1913 | 3076 | GLUTAMATE N-ACETYLTRANSFERASE (EC 2.3.1.35)/AMINO-ACID ACETYLTRANSFERASE (EC 2.3.1.1) |
| 319 | 320 | RXA02156 | GR00640 | 3125 | 4075 | ACETYLGLUTAMATE KINASE (EC 2.7.2.8) |
| 321 | 322 | RXN02153 | VV0122 | 14106 | 13327 | N-ACETYL-GAMMA-GLUTAMYL-PHOSPHATE REDUCTASE (EC 1.2.1.38) |
| 323 | 324 | F RXA02153 | GR00640 | 757 | 1536 | N-ACETYLGLUTAMATE-5-SEMIALDEHYDE DEHYDROGENASE |
| 325 | 326 | RXA02154 | GR00640 | 1536 | 1826 | N-ACETYLGLUTAMATE-5-SEMIALDEHYDE DEHYDROGENASE |
| 327 | 328 | RXA02157 | GR00640 | 4079 | 5251 | ACETYLORNITHINE AMINOTRANSFERASE (EC 2.6.1.11) |
| 329 | 330 | RXS02970 | | | | ACETYLORNITHINE AMINOTRANSFERASE (EC 2.6.1.11) |
| 331 | 332 | F RXA01009 | GR00287 | 4714 | 5943 | ACETYLORNITHINE AMINOTRANSFERASE (EC 2.6.1.11) |
| 333 | 334 | RXA02158 | GR00640 | 5268 | 6224 | ORNITHINE CARBAMOYLTRANSFERASE (EC 2.1.3.3) |
| 335 | 336 | RXA02160 | GR00640 | 6914 | 8116 | ARGININOSUCCINATE SYNTHASE (EC 6.3.4.5) |
| 337 | 338 | RXN02162 | VV0122 | 6683 | 5253 | ARGININOSUCCINATE LYASE (EC 4.3.2.1) |
| 339 | 340 | F RXA02161 | GR00640 | 8180 | 8962 | ARGININOSUCCINATE LYASE (EC 4.3.2.1) |
| 341 | 342 | F RXA02162 | GR00640 | 8949 | 9611 | ARGININOSUCCINATE LYASE (EC 4.3.2.1) |
| 343 | 344 | RXA02262 | GR00654 | 32291 | 33436 | ORNITHINE CYCLODEAMINASE (EC 4.3.1.12) |
| 345 | 346 | RXA00219 | GR00032 | 19289 | 20230 | SPERMIDINE SYNTHASE (EC 2.5.1.16) |
| 347 | 348 | RXA01508 | GR00424 | 12652 | 14190 | SPERMIDINE SYNTHASE (EC 2.5.1.16) |
| 349 | 350 | RXA01757 | GR00498 | 2942 | 2142 | PUTRESCINE OXIDASE (EC 1.4.3.10) |
| 351 | 352 | RXA02159 | GR00640 | 6231 | 6743 | ARGININE HYDROXIMATE RESISTANCE PROTEIN |
| 353 | 354 | RXN02154 | VV0122 | 13327 | 13037 | N-ACETYL-GAMMA-GLUTAMYL-PHOSPHATE REDUCTASE (EC 1.2.1.38) |
| 355 | 356 | RXS00147 | | | | CARBAMOYL-PHOSPHATE SYNTHASE SMALL CHAIN (EC 6.3.5.5) |
| 357 | 358 | RXS00905 | | | | N-ACYL-L-AMINO ACID AMIDOHYDROLASE (EC 3.5.1.14) |
| 359 | 360 | RXS00906 | | | | N-ACYL-L-AMINO ACID AMIDOHYDROLASE (EC 3.5.1.14) |
| 361 | 362 | RXS00907 | | | | N-ACYL-L-AMINO ACID AMIDOHYDROLASE (EC 3.5.1.14) |
| 363 | 364 | RXS02001 | | | | N-ACYL-L-AMINO ACID AMIDOHYDROLASE (EC 3.5.1.14) |
| 365 | 366 | RXS02101 | | | | N-ACYL-L-AMINO ACID AMIDOHYDROLASE (EC 3.5.1.14) |
| 367 | 368 | RXS02234 | | | | CARBAMOYL-PHOSPHATE SYNTHASE LARGE CHAIN (EC 6.3.5.5) |
| 369 | 370 | F RXA02234 | GR00654 | 1 | 3198 | CARBAMOYL-PHOSPHATE SYNTHASE LARGE CHAIN (EC 6.3.5.5) |
| 371 | 372 | RXS02565 | | | | N-ACYL-L-AMINO ACID AMIDOHYDROLASE (EC 3.5.1.14) |
| 373 | 374 | RXS02937 | | | | N-ACYL-L-AMINO ACID AMIDOHYDROLASE (EC 3.5.1.14) |
| | | | | | | Histidine metabolism |
| 375 | 376 | RXA02194 | GR00645 | 2897 | 2055 | ATP PHOSPHORIBOSYLTRANSFERASE (EC 2.4.2.17) |
| 377 | 378 | RXA02195 | GR00645 | 3186 | 2917 | PHOSPHORIBOSYL-ATP PYROPHOSPHOHYDROLASE (EC 3.6.1.31) |
| 379 | 380 | RXA01097 | GR00306 | 4726 | 4373 | PHOSPHORIBOSYL-AMP CYCLOHYDROLASE (EC 3.5.4.19) |
| 381 | 382 | RXA01100 | GR00306 | 7072 | 6335 | PHOSPHORIBOSYLFORMIMINO-5-AMINOIMIDAZOLE CARBOXAMIDE RIBOTIDE ISOMERASE (EC 5.3.1.16) |
| 383 | 384 | RXA01101 | GR00306 | 7726 | 7094 | AMIDOTRANSFERASE HISH (EC 2.4.2.-) |
| 385 | 386 | RXN01657 | VV0010 | 39950 | 39351 | AMIDOTRANSFERASE HISH (EC 2.4.2.-) |
| 387 | 388 | F RXA01657 | GR00460 | 2444 | 2944 | AMIDOTRANSFERASE HISH (EC 2.4.2.-) |
| 389 | 390 | RXA01098 | GR00306 | 5499 | 4726 | HISF PROTEIN |
| 391 | 392 | RXN01104 | VV0059 | 7037 | 6432 | IMIDAZOLEGLYCEROL-PHOSPHATE DEHYDRATASE (EC 4.2.1.19) |
| 393 | 394 | F RXA01104 | GR00306 | 10927 | 10322 | IMIDAZOLEGLYCEROL-PHOSPHATE DEHYDRATASE (EC 4.2.1.19)/HISTIDINOL-PHOSPHATASE (EC 3.1.3.15) |
| 395 | 396 | RXN00446 | VV0112 | 24181 | 23318 | HISTIDINOL-PHOSPHATE AMINOTRANSFERASE (EC 2.6.1.9) |
| 397 | 398 | F RXA00446 | GR00108 | 4 | 525 | HISTIDINOL-PHOSPHATE AMINOTRANSFERASE (EC 2.6.1.9) |
| 399 | 400 | RXA1105 | GR00306 | 12044 | 10947 | HISTIDINOL-PHOSPHATE AMINOTRANSFERASE (EC 2.6.1.9) |
| 401 | 402 | RXA01106 | GR00306 | 13378 | 12053 | HISTIDINOL DEHYDROGENASE (EC 1.1.1.23) |
| 403 | 404 | RXC00930 | | | | PROTEIN INVOLVED IN HISTIDINE METABOLISM |
| 405 | 406 | RXC01096 | | | | PROTEIN INVOLVED IN HISTIDINE METABOLISM |
| 407 | 408 | RXC01656 | | | | PROTEIN INVOLVED IN HISTIDINE METABOLISM |
| 409 | 410 | RXC01158 | | | | MEMBRANE SPANNING PROTEIN INVOLVED IN HISTIDINE METABOLISM |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| | | | | | | Metabolism of aromatic amino acids |
| 411 | 412 | RXA02458 | GR00712 | 3056 | 4345 | 3-PHOSPHOSHIKIMATE 1-CARBOXYVINYLTRANSFERASE (EC 2.5.1.19) |
| 413 | 414 | RXA02790 | GR00777 | 5806 | 6948 | 4-AMINO-4-DEOXYCHORISMATE LYASE (EC 4.-.-.-) |
| 415 | 416 | RXN00954 | VV0247 | 3197 | 2577 | ANTHRANILATE PHOSPHORIBOSYLTRANSFERASE (EC 2.4.2.18) |
| 417 | 418 | F RXA00954 | GR00263 | 3 | 590 | ANTHRANILATE PHOSPHORIBOSYLTRANSFERASE (EC 2.4.2.18) |
| 419 | 420 | RXN00957 | VV0208 | 1211 | 2764 | ANTHRANILATE SYNTHASE COMPONENT I (EC 4.1.3.27) |
| 421 | 422 | F RXA00957 | GR00264 | 3 | 1130 | ANTHRANILATE SYNTHASE COMPONENT I (EC 4.1.3.27) |
| 423 | 424 | RXA02687 | GR00754 | 11306 | 12250 | CHORISMATE MUTASE (EC 5.4.99.5)/PREPHENATE DEHYDRATASE (EC 4.2.1.51) |
| 425 | 426 | RXN01698 | VV0134 | 11507 | 12736 | CHORISMATE SYNTHASE (EC 4.6.1.4) |
| 427 | 428 | F RXA01698 | GR00477 | 2 | 991 | CHORISMATE SYNTHASE (EC 4.6.1.4) |
| 429 | 430 | RXA01095 | GR00306 | 3603 | 2821 | INDOLE-3-GLYCEROL PHOSPHATE SYNTHASE (EC 4.1.1.48) |
| 431 | 432 | RXA00955 | GR00263 | 586 | 2007 | INDOLE-3-GLYCEROL PHOSPHATE SYNTHASE (EC 4.1.1.48)/ N-(5'-PHOSPHO-RIBOSYL)ANTHRANILATE ISOMERASE (EC 5.3.1.24) |
| 433 | 434 | RXA02814 | GR00795 | 598 | 128 | ISOCHORISMATE MUTASE |
| 435 | 436 | RXA00229 | GR00033 | 1715 | 936 | SHIKIMATE 5-DEHYDROGENASE (EC 1.1.1.25) |
| 437 | 438 | RXA02093 | GR00629 | 12444 | 13247 | SHIKIMATE 5-DEHYDROGENASE (EC 1.1.1.25) |
| 439 | 440 | RXA02791 | GR00777 | 6968 | 7795 | SHIKIMATE 5-DEHYDROGENASE (EC 1.1.1.25) |
| 441 | 442 | RXA01699 | GR00477 | 984 | 1553 | SHIKIMATE KINASE (EC 2.7.1.71) |
| 443 | 444 | RXA00952 | GR00262 | 97 | 936 | TRYPTOPHAN SYNTHASE ALPHA CHAIN (EC 4.2.1.20) |
| 445 | 446 | RXN00956 | VV0247 | 1140 | 4 | TRYPTOPHAN SYNTHASE BETA CHAIN (EC 4.2.1.20) |
| 447 | 448 | F RXA00956 | GR00263 | 2027 | 3157 | TRYPTOPHAN SYNTHASE BETA CHAIN (EC 4.2.1.20) |
| 449 | 450 | RXA00064 | GR00010 | 2499 | 3776 | TYROSINE AMINOTRANSFERASE (EC 2.6.1.5) |
| 451 | 452 | RXN00448 | VV0112 | 33959 | 32940 | PREPHENATE DEHYDROGENASE (EC 1.3.1.12) |
| 453 | 454 | F RXA00448 | GR00109 | 3 | 668 | PREPHENATE DEHYDROGENASE (EC 1.3.1.12) |
| 455 | 456 | F RXA00452 | GR00110 | 854 | 1099 | PREPHENATE DEHYDROGENASE (EC 1.3.1.12) |
| 457 | 458 | RXA00584 | GR00156 | 11384 | 10260 | PHOSPHO-2-DEHYDRO-3-DEOXYHEPTONATE ALDOLASE (EC 4.1.2.15) |
| 459 | 460 | RXA00579 | GR00156 | 5946 | 4087 | PARA-AMINOBENZOATE SYNTHASE COMPONENT I (EC 4.1.3.-) |
| 461 | 462 | RXA00958 | GR00264 | 1130 | 1753 | PARA-AMINOBENZOATE SYNTHASE GLUTAMINE AMIDOTRANSFERASE COMPONENT II (EC 4.1.3.-)/ANTHRANILATE SYNTHASE COMPONENT II (EC 4.1.3.27) |
| 463 | 464 | RXN03007 | VV0208 | 3410 | 3778 | ANTHRANILATE SYNTHASE COMPONENT II (EC 4.1.3.27) |
| 465 | 466 | RXN02918 | VV0086 | 25447 | 25887 | TRYPTOPHAN SYNTHASE BETA CHAIN (EC 4.2.1.20) |
| 467 | 468 | RXN01116 | VV0182 | 7497 | 6886 | 3-OXOADIPATE COA-TRANSFERASE SUBUNIT B (EC 2.8.3.6) |
| 469 | 470 | RXN01115 | VV0182 | 10347 | 11099 | 3-OXOADIPATE ENOL-LACTONE HYDROLASE (EC 3.1.1.24)/4-CARBOXYMUCONOLACTONE |
| 471 | 472 | RXS00116 | | | | ASPARTATE AMINOTRANSFERASE (EC 2.6.1.1) |
| 473 | 474 | F RXA00116 | GR00018 | 510 | 4 | ASPARTATE AMINOTRANSFERASE (EC 2.6.1.1) |
| 475 | 476 | RXS00391 | | | | O-SUCCINYLBENZOIC ACID-COA LIGASE (EC 6.2.1.26) |
| 477 | 478 | RXS00393 | | | | 1,4-DIHYDROXY-2-NAPHTHOATE OCTAPRENYLTRANSFERASE (EC 2.5.-.-) |
| 479 | 480 | F RXA00393 | GR00086 | 4030 | 4911 | 1,4-DIHYDROXY-2-NAPHTHOATE OCTAPRENYLTRANSFERASE (EC 2.5.-.-) |
| 481 | 482 | RXS00446 | | | | HISTIDINOL-PHOSPHATE AMINOTRANSFERASE (EC 2.6.1.9) |
| 483 | 484 | F RXA00446 | GR00108 | 4 | 525 | HISTIDINOL-PHOSPHATE AMINOTRANSFERASE (EC 2.6.1.9) |
| 485 | 486 | RXS00618 | | | | ASPARTATE AMINOTRANSFERASE (EC 2.6.1.1) |
| 487 | 488 | F RXA00618 | GR00163 | 213 | 746 | ASPARTATE AMINOTRANSFERASE (EC 2.6.1.1) |
| 489 | 490 | F RXA00627 | GR00164 | 854 | 1138 | ASPARTATE AMINOTRANSFERASE (EC 2.6.1.1) |
| 491 | 492 | RXS01105 | | | | HISTIDINOL-PHOSPHATE AMINOTRANSFERASE (EC 2.6.1.9) |
| 493 | 494 | RXS02315 | | | | 2-SUCCINYL-6-HYDROXY-2,4-CYCLOHEXADIENE-1-CARBOXYLATE SYNTHASE/2-OXOGLUTARATE DECARBOXYLASE (EC 4.1.1.71) |
| 495 | 496 | RXS02550 | | | | ASPARTATE AMINOTRANSFERASE (EC 2.6.1.1) |
| 497 | 498 | RXS02319 | | | | NAPHTHOATE SYNTHASE (EC 4.1.3.36) |
| 499 | 500 | RXS02908 | | | | O-SUCCINYLBENZOIC ACID-COA LIGASE (EC 6.2.1.26) |
| 501 | 502 | RXS03003 | | | | ASPARTATE AMINOTRANSFERASE (EC 2.6.1.1) |
| 503 | 504 | RXS03026 | | | | 3-DEHYDROQUINATE DEHYDRATASE (EC 4.2.1.10) |
| 505 | 506 | RXS03074 | | | | S-ADENOSYLMETHIONINE: 2-DEMETHYLMENAQUINONE METHYLTRANSFERASE (EC 2.1.-.-) |
| 507 | 508 | RXC01434 | | | | MEMBRANE SPANNING PROTEIN INVOLVED IN METABOLISM OF AROMATIC AMINO ACIDS AND RIBOFLAVIN |
| 509 | 510 | RXC02080 | | | | MEMBRANE SPANNING PROTEIN INVOLVED IN METABOLISM OF AROMATIC AMINO ACIDS |
| 511 | 512 | RXC02789 | | | | CYTOSOLIC PROTEIN INVOLVED IN METABOLISM OF AROMATIC AMINO ACIDS |
| 513 | 514 | RXC02295 | | | | MEMBRANE SPANNING PROTEIN INVOLVED IN METABOLISM OF AROMATIC AMINO ACIDS |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| | | | | | | Aminobutyrate metabolism |
| 515 | 516 | RXN03063 | VV0035 | 666 | 1697 | 4-aminobutyrate aminotransferase (EC 2.6.1.19) |
| 517 | 518 | RXN02970 | VV0021 | 4714 | 6081 | ACETYLORNITHINE AMINOTRANSFERASE (EC 2.6.1.11) |
| 519 | 520 | F RXA01009 | GR00287 | 4714 | 5943 | ACETYLORNITHINE AMINOTRANSFERASE (EC 2.6.1.11) |
| | | | | | | Vitamins, vitamin-like substances (cofactors), nutraceuticals |
| | | | | | | Thiamine metabolism |
| 521 | 522 | RXA01551 | GR00431 | 2945 | 4819 | THIAMIN BIOSYNTHESIS PROTEIN THIC |
| 523 | 524 | RXA01019 | GR00291 | 6 | 995 | THIAMIN-MONOPHOSPHATE KINASE (EC 2.7.4.16) |
| 525 | 526 | RXA01352 | GR00393 | 609 | 4 | THIAMIN-PHOSPHATE PYROPHOSPHORYLASE (EC 2.5.1.3) |
| 527 | 528 | RXA01381 | GR00403 | 3206 | 2286 | THIF PROTEIN |
| 529 | 530 | RXA01360 | GR00394 | 162 | 4 | THIG PROTEIN |
| 531 | 532 | RXA01361 | GR00394 | 983 | 378 | THIG PROTEIN |
| 533 | 534 | RXA01208 | GR00348 | 229 | 1032 | HYDROXYETHYLTHIAZOLE KINASE (EC 2.7.1.50) |
| 535 | 536 | RXA00838 | GR00227 | 1532 | 633 | APBA PROTEIN |
| 537 | 538 | RXA02400 | GR00699 | 1988 | 2557 | THIAMIN BIOSYNTHESIS PROTEIN X |
| 539 | 540 | RXN01209 | VV0270 | 1019 | 2446 | PHOSPHOMETHYLPYRIMIDINE KINASE (EC 2.7.4.7) |
| 541 | 542 | F RXA01209 | GR00348 | 1019 | 2446 | PHOSPHOMETHYLPYRIMIDINE KINASE (EC 2.7.4.7) |
| 543 | 544 | RXN01413 | VV0050 | 27306 | 27905 | PHOSPHOMETHYLPYRIMIDINE KINASE (EC 2.7.4.7) |
| 545 | 546 | RXN01617 | VV0050 | 22187 | 22858 | PHOSPHOMETHYLPYRIMIDINE KINASE (EC 2.7.4.7) |
| 547 | 548 | F RXA01617 | GR00451 | 2 | 616 | PHOSPHOMETHYLPYRIMIDINE KINASE (EC 2.7.4.7) |
| 549 | 550 | RXS01807 | | | | PYRIDOXINE KINASE (EC 2.7.1.35) |
| 551 | 552 | RXC01021 | | | | CYTOSOLIC KINASE INVOLVED IN METABOLISM OF SUGARS AND THIAMIN |
| | | | | | | Riboflavin metabolism |
| 553 | 554 | RXN02246 | VV0130 | 4388 | 5371 | diaminohydroxyphosphoribosylaminopyrimidine deaminase (EC 3.5.4.26)/ 5-amino-6-(5-phosphoribosylamino)uracil reductase (EC 1.1.1.193) |
| 555 | 556 | F RXA02246 | GR00654 | 14299 | 15282 | RIBG PROTEIN riboflavin-specific deaminase [EC: 3.5.4.-] |
| 557 | 558 | RXA02247 | GR00654 | 15286 | 15918 | RIBOFLAVIN SYNTHASE ALPHA CHAIN (EC 2.5.1.9) |
| 559 | 560 | RXN02248 | VV0130 | 6021 | 7286 | GTP CYCLOHYDROLASE II (EC 3.5.4.25)/ 3,4-DIHYDROXY-2-BUTANONE 4-PHOSPHATE SYNTHASE |
| 561 | 562 | F RXA02248 | GR00654 | 15932 | 17197 | RIBA PROTEIN - GTP cyclohydrolase II [EC: 3.5.4.25] |
| 563 | 564 | RXN02249 | VV0130 | 7301 | 7777 | 6,7-DIMETHYL-8-RIBITYLLUMAZINE SYNTHASE (EC 2.5.1.9) |
| 565 | 566 | F RXA02249 | GR00654 | 17212 | 17688 | RIBH PROTEIN - 6,7-dimethyl-8-ribityllumazine synthase (dmrl synthase, lumazine synthase, riboflavin synthase beta chain) [EC: 2.5.1.9] |
| 567 | 568 | RXA02250 | GR00654 | 17778 | 18356 | RIBX PROTEIN |
| 569 | 570 | RXA01489 | GR00423 | 3410 | 2388 | RIBOFLAVIN KINASE (EC 2.7.1.26)/FMN ADENYLYLTRANSFERASE (EC 2.7.7.2) |
| 571 | 572 | RXA02135 | GR00639 | 2809 | 1736 | NICOTINATE-NUCLEOTIDE-DIMETHYLBENZIMIDAZOLE PHOSPHORIBOSYLTRANSFERASE (EC 2.4.2.21) |
| 573 | 574 | RXA01489 | GR00423 | 3410 | 2388 | RIBOFLAVIN KINASE (EC 2.7.1.26)/FMN ADENYLYLTRANSFERASE (EC 2.7.7.2) |
| 575 | 576 | RXN01712 | VV0191 | 8993 | 8298 | RIBOFLAVIN-SPECIFIC DEAMINASE (EC 3.5.4.-) |
| 577 | 578 | F RXA01712 | GR00484 | 2652 | 2152 | RIBOFLAVIN-SPECIFIC DEAMINASE (EC 3.5.4.-) |
| 579 | 580 | RXN02384 | VV0213 | 1386 | 679 | ALPHA-RIBAZOLE-5'-PHOSPHATE PHOSPHATASE (EC 3.1.3.-) |
| 581 | 582 | RXN01560 | VV0319 | 767 | 438 | RIBOFLAVIN-SPECIFIC DEAMINASE (EC 3.5.4.-) |
| 583 | 584 | RXN00667 | VV0109 | 1363 | 350 | DRAP DEAMINASE |
| 585 | 586 | RXC01711 | | | | MEMBRANE SPANNING PROTEIN INVOLVED IN RIBOFLAVIN METABOLISM |
| 587 | 588 | RXC02380 | | | | PROTEIN INVOLVED IN RIBOFLAVIN METABOLISM |
| 589 | 590 | F RXA02380 | GR00691 | 709 | 56 | Predicted nucleotidyltransferases |
| 591 | 592 | RXC02921 | | | | CYTOSOLIC PROTEIN INVOLVED IN METABOLISM OF RIBOFLAVIN AND LIPIDS |
| 593 | 594 | RXC01434 | | | | MEMBRANE SPANNING PROTEIN INVOLVED IN METABOLISM OF AROMATIC AMINO ACIDS AND RIBOFLAVIN |
| | | | | | | Vitamin B6 metabolism |
| 595 | 596 | RXA01807 | GR00509 | 7868 | 7077 | PYRIDOXINE KINASE (EC 2.7.1.35), pyridoxal/pyridoxine/pyridoxamine kinase |
| | | | | | | Nicotinate (nicotinic acid), nicotinamide, NAD and NADP |
| 597 | 598 | RXN02754 | VV0084 | 22564 | 23901 | NICOTINATE PHOSPHORIBOSYLTRANSFERASE (EC 2.4.2.11) |
| 599 | 600 | F RXA02405 | GR00701 | 774 | 4 | NICOTINATE PHOSPHORIBOSYLTRANSFERASE (EC 2.4.2.11) |
| 601 | 602 | F RXA02754 | GR00766 | 3 | 488 | NICOTINATE PHOSPHORIBOSYLTRANSFERASE (EC 2.4.2.11) |
| 603 | 604 | RXA02112 | GR00632 | 5600 | 6436 | NICOTINATE-NUCLEOTIDE PYROPHOSPHORYLASE (CARBOXYLATING) (EC 2.4.2.19) |
| 605 | 606 | RXA02111 | GR00632 | 4310 | 5593 | QUINOLINATE SYNTHETASE A |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| | | | | | | NAD Biosynthesis |
| 607 | 608 | RXA01073 | GR00300 | 1274 | 2104 | NH(3)-DEPENDENT NAD(+) SYNTHETASE (EC 6.3.5.1) |
| 609 | 610 | RXN02754 | VV0084 | 22564 | 23901 | NICOTINATE PHOSPHORIBOSYLTRANSFERASE (EC 2.4.2.11) |
| | | | | | | Pantothenate and Coenzyme A (CoA) biosynthesis |
| 611 | 612 | RXA02299 | GR00662 | 10452 | 10859 | ASPARTATE 1-DECARBOXYLASE PRECURSOR (EC 4.1.1.11) |
| 613 | 614 | RXA01928 | GR00555 | 1957 | 1121 | PANTOATE-BETA-ALANINE LIGASE (EC 6.3.2.1) |
| 615 | 616 | RXN01929 | VV0127 | 47590 | 48402 | 3-METHYL-2-OXOBUTANOATE HYDROXYMETHYLTRANSFERASE (EC 2.1.2.11)/DECARBOXYLASE (EC 4.1.1.44) |
| 617 | 618 | F RXA01929 | GR00555 | 2766 | 1960 | 3-METHYL-2-OXOBUTANOATE HYDROXYMETHYLTRANSFERASE (EC 2.1.2.11) |
| 619 | 620 | RXA01521 | GR00424 | 25167 | 25964 | PANTOATE-BETA-ALANINE LIGASE (EC 6.3.2.1) |
| 621 | 622 | RXS01145 | | | | KETOL-ACID REDUCTOISOMERASE (EC 1.1.1.86) |
| 623 | 624 | F RXA01145 | GR00321 | 1075 | 1530 | KETOL-ACID REDUCTOISOMERASE (EC 1.1.1.86) |
| 625 | 626 | RXA02239 | GR00654 | 5784 | 7049 | DNA/PANTOTHENATE METABOLISM FLAVOPROTEIN |
| 627 | 628 | RXA00581 | GR00156 | 7572 | 8540 | PANTOTHENATE KINASE (EC 2.7.1.33) |
| 629 | 630 | RXS00838 | | | | 2-DEHYDROPANTOATE 2-REDUCTASE (EC 1.1.1.169) |
| 631 | 632 | RXC02238 | | | | PROTEIN INVOLVED IN METABOLISM OF S-ADENOSYLMETHIONINE, PURINES AND PANTOTHENATE |
| | | | | | | Biotin metabolism |
| 633 | 634 | RXN03058 | VV0028 | 8272 | 8754 | BIOTIN SYNTHESIS PROTEIN BIOC |
| 635 | 636 | F RXA02903 | GR10040 | 11532 | 12014 | BIOTIN SYNTHESIS PROTEIN BIOC |
| 637 | 638 | RXA00166 | GR00025 | 3650 | 4309 | BIOTIN SYNTHESIS PROTEIN BIOC |
| 639 | 640 | RXA00633 | GR00166 | 3556 | 2288 | ADENOSYLMETHIONINE-8-AMINO-7-OXONONANOATE AMINOTRANSFERASE (EC 2.6.1.62) |
| 641 | 642 | RXA00632 | GR00166 | 2281 | 1610 | DETHIOBIOTIN SYNTHETASE (EC 6.3.3.3) |
| 643 | 644 | RXA00295 | GR00047 | 3407 | 4408 | BIOTIN SYNTHASE (EC 2.8.1.6) |
| 645 | 646 | RXA00223 | GR00032 | 23967 | 22879 | NIFS PROTEIN |
| 647 | 648 | RXN00262 | VV0123 | 16681 | 15608 | NIFS PROTEIN |
| 649 | 650 | F RXA00262 | GR00040 | 79 | 897 | NIFS PROTEIN |
| 651 | 652 | RXN00435 | VV0112 | 10037 | 11209 | NIFS PROTEIN |
| 653 | 654 | F RXA00435 | GR00100 | 3563 | 2949 | NIFS PROTEIN |
| 655 | 656 | F RXA02801 | GR00782 | 438 | 4 | NIFS PROTEIN |
| 657 | 658 | RXA02516 | GR00723 | 1724 | 2986 | NIFS PROTEIN |
| 659 | 660 | RXA02517 | GR00723 | 2989 | 3435 | NIFU PROTEIN |
| | | | | | | Lipoic Acid |
| 661 | 662 | RXA01747 | GR00495 | 2506 | 3549 | LIPOIC ACID SYNTHETASE |
| 663 | 664 | RXA01746 | GR00495 | 1614 | 2366 | LIPOATE-PROTEIN LIGASE B (EC 6.-.-.-) |
| 665 | 666 | RXA02106 | GR00632 | 472 | 1527 | LIPOATE-PROTEIN LIGASE A (EC 6.-.-.-) |
| 667 | 668 | RXS01183 | | | | DIHYDROLIPOAMIDE SUCCINYLTRANSFERASE COMPONENT (E2) OF 2-OXOGLUTARATE DEHYDROGENASE COMPLEX (EC 2.3.1.61) |
| 669 | 670 | RXS01260 | | | | LIPOAMIDE DEHYDROGENASE COMPONENT (E3) OF BRANCHED-CHAIN ALPHA-KETO ACID DEHYDROGENASE COMPLEX (EC 1.8.1.4) |
| 671 | 672 | RXS01261 | | | | LIPOAMIDE DEHYDROGENASE COMPONENT (E3) OF BRANCHED-CHAIN ALPHA-KETO ACID DEHYDROGENASE COMPLEX (EC 1.8.1.4) |
| | | | | | | Folate biosynthesis |
| 673 | 674 | RXA02717 | GR00758 | 18281 | 17400 | 5,10-METHYLENETETRAHYDROFOLATE REDUCTASE (EC 1.7.99.5) |
| 675 | 676 | RXN02027 | VV0296 | 503 | 1003 | 5-FORMYLTETRAHYDROFOLATE CYCLO-LIGASE (EC 6.3.3.2) |
| 677 | 678 | F RXA02027 | GR00616 | 500 | 6 | 5-FORMYLTETRAHYDROFOLATE CYCLO-LIGASE (EC 6.3.3.2) |
| 679 | 680 | RXA00106 | GR00014 | 17469 | 17924 | DIHYDROFOLATE REDUCTASE (EC 1.5.1.3) |
| 681 | 682 | RXN01321 | VV0082 | 8868 | 9788 | FORMYLTETRAHYDROFOLATE DEFORMYLASE (EC 3.5.1.10) |
| 683 | 684 | F RXA01321 | GR00384 | 23 | 559 | FORMYLTETRAHYDROFOLATE DEFORMYLASE (EC 3.5.1.10) |
| 685 | 686 | RXA00461 | GR00116 | 428 | 1279 | METHYLENETETRAHYDROFOLATE DEHYDROGENASE (EC 1.5.1.5)/ METHENYLTETRAHYDROFOLATE CYCLOHYDROLASE (EC 3.5.4.9) |
| 687 | 688 | RXA01514 | GR00424 | 20922 | 21509 | GTP CYCLOHYDROLASE I (EC 3.5.4.16) |
| 689 | 690 | RXA01516 | GR00424 | 22360 | 22749 | DIHYDRONEOPTERIN ALDOLASE (EC 4.1.2.25) |
| 691 | 692 | RXA01515 | GR00424 | 21513 | 22364 | DIHYDROPTEROATE SYNTHASE (EC 2.5.1.15) |
| 693 | 694 | RXA02024 | GR00613 | 4026 | 4784 | DIHYDROPTEROATE SYNTHASE (EC 2.5.1.15) |
| 695 | 696 | RXA00106 | GR00014 | 17469 | 17924 | DIHYDROFOLATE REDUCTASE (EC 1.5.1.3) |
| 697 | 698 | RXA00989 | GR00280 | 2903 | 1371 | FOLYLPOLYGLUTAMATE SYNTHASE (EC 6.3.2.17) |
| 699 | 700 | RXA01517 | GR00424 | 22752 | 23228 | 2-AMINO-4-HYDROXY-6-HYDROXYMETHYLDIHYDROPTERIDINE PYROPHOSPHOKINASE (EC 2.7.6.3) |
| 701 | 702 | RXA00579 | GR00156 | 5946 | 4087 | PARA-AMINOBENZOATE SYNTHASE COMPONENT I (EC 4.1.3.-) |
| 703 | 704 | RXA00958 | GR00264 | 1130 | 1753 | PARA-AMINOBENZOATE SYNTHASE GLUTAMINE AMIDOTRANSFERASE COMPONENT II (EC 4.1.3.-)/ANTHRANILATE SYNTHASE COMPONENT II (EC 4.1.3.27) |
| 705 | 706 | RXA02790 | GR00777 | 5806 | 6948 | 4-AMINO-4-DEOXYCHORISMATE LYASE (EC 4.-.-.-) |
| 707 | 708 | RXA00106 | GR00014 | 17469 | 17924 | DIHYDROFOLATE REDUCTASE (EC 1.5.1.3) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 709 | 710 | RXN02198 | VV0302 | 9228 | 11726 | 5-METHYLTETRAHYDROFOLATE-HOMOCYSTEINE METHYLTRANSFERASE (EC 2.1.1.13) |
| 711 | 712 | F RXA02198 | GR00646 | 2483 | 6 | 5-METHYLTETRAHYDROFOLATE-HOMOCYSTEINE METHYLTRANSFERASE (EC 2.1.1.13) |
| 713 | 714 | RXN02085 | VV0126 | 8483 | 10717 | 5-METHYLTETRAHYDROPTEROYLTRIGLUTAMATE-HOMOCYSTEINE METHYLTRANSFERASE |
| 715 | 716 | F RXA02085 | GR00629 | 3496 | 5295 | 5-METHYLTETRAHYDROPTEROYLTRIGLUTAMATE-HOMOCYSTEINE METHYLTRANSFERASE (EC 2.1.1.14) |
| 717 | 718 | F RXA02086 | GR00629 | 5252 | 5731 | 5-METHYLTETRAHYDROPTEROYLTRIGLUTAMATE-HOMOCYSTEINE METHYLTRANSFERASE (EC 2.1.1.14) |
| 719 | 720 | RXN02648 | | | | 5-METHYLTETRAHYDROPTEROYLTRIGLUTAMATE-HOMOCYSTEINE METHYLTRANSFERASE (EC 2.1.1.14) |
| 721 | 722 | F RXA02648 | GR00751 | 5254 | 4730 | 5-METHYLTETRAHYDROPTEROYLTRIGLUTAMATE-HOMOCYSTEINE METHYLTRANSFERASE (EC 2.1.1.14) |
| 723 | 724 | F RXA02658 | GR00752 | 14764 | 15447 | 5-METHYLTETRAHYDROPTEROYLTRIGLUTAMATE-HOMOCYSTEINE METHYLTRANSFERASE (EC 2.1.1.14) |
| 725 | 726 | RXS02197 | | | | 5-METHYLTETRAHYDROFOLATE-HOMOCYSTEINE METHYLTRANSFERASE (EC 2.1.1.13) |
| 727 | 728 | RXC00988 | | | | PROTEIN INVOLVED IN FOLATE METABOLISM |
| 729 | 730 | RXC01518 | | | | MEMBRANE SPANNING PROTEIN INVOLVED IN FOLATE METABOLISM |
| 731 | 732 | RXC01942 | | | | ATP-BINDING PROTEIN INVOLVED IN FOLATE METABOLISM |
| | | | | | | Molybdopterin Metabolism |
| 733 | 734 | RXN02802 | VV0112 | 17369 | 16299 | MOLYBDOPTERIN BIOSYNTHESIS MOEB PROTEIN |
| 735 | 736 | F RXA02802 | GR00783 | 7 | 474 | MOLYBDOPTERIN BIOSYNTHESIS MOEB PROTEIN |
| 737 | 738 | F RXA00438 | GR00103 | 362 | 796 | MOLYBDOPTERIN BIOSYNTHESIS MOEB PROTEIN |
| 739 | 740 | RXN00437 | VV0112 | 17824 | 17369 | MOLYBDOPTERIN (MPT) CONVERTING FACTOR, SUBUNIT 2 |
| 741 | 742 | F RXA00437 | GR00103 | 3 | 362 | MOLYBDOPTERIN (MPT) CONVERTING FACTOR, SUBUNIT 2 |
| 743 | 744 | RXN00439 | VV0112 | 18742 | 18275 | MOLYBDOPTERIN CO-FACTOR SYNTHESIS PROTEIN |
| 745 | 746 | F RXA00439 | GR00104 | 2 | 196 | MOLYBDOPTERIN CO-FACTOR SYNTHESIS PROTEIN |
| 747 | 748 | F RXA00442 | GR00105 | 830 | 1087 | MOLYBDOPTERIN CO-FACTOR SYNTHESIS PROTEIN |
| 749 | 750 | RXA00440 | GR00104 | 196 | 654 | MOLYBDENUM COFACTOR BIOSYNTHESIS PROTEIN CB |
| 751 | 752 | RXN00441 | VV0112 | 19942 | 18779 | MOLYBDOPTERIN CO-FACTOR SYNTHESIS PROTEIN |
| 753 | 754 | F RXA00441 | GR00105 | 2 | 793 | MOLYBDOPTERIN CO-FACTOR SYNTHESIS PROTEIN |
| 755 | 756 | RXN02085 | | | | 5-METHYLTETRAHYDROPTEROYLTRIGLUTAMATE-HOMOCYSTEINE METHYLTRANSFERASE (EC 2.1.1.14) |
| 757 | 758 | F RXA02085 | GR00629 | 3496 | 5295 | 5-METHYLTETRAHYDROPTEROYLTRIGLUTAMATE-HOMOCYSTEINE METHYLTRANSFERASE (EC 2.1.1.14) |
| 759 | 760 | F RXA02086 | GR00629 | 5252 | 5731 | 5-METHYLTETRAHYDROPTEROYLTRIGLUTAMATE-HOMOCYSTEINE METHYLTRANSFERASE (EC 2.1.1.14) |
| 761 | 762 | RXN02648 | | | | 5-METHYLTETRAHYDROPTEROYLTRIGLUTAMATE-HOMOCYSTEINE METHYLTRANSFERASE (EC 2.1.1.14) |
| 763 | 764 | F RXA02648 | GR00751 | 5254 | 4730 | 5-METHYLTETRAHYDROPTEROYLTRIGLUTAMATE-HOMOCYSTEINE METHYLTRANSFERASE (EC 2.1.1.14) |
| 765 | 766 | F RXA02658 | GR00752 | 14764 | 15447 | 5-METHYLTETRAHYDROPTEROYLTRIGLUTAMATE-HOMOCYSTEINE METHYLTRANSFERASE (EC 2.1.1.14) |
| 767 | 768 | RXA01516 | GR00424 | 22360 | 22749 | DIHYDRONEOPTERIN ALDOLASE (EC 4.1.2.25) |
| 769 | 770 | RXA01515 | GR00424 | 21513 | 22364 | DIHYDROPTEROATE SYNTHASE (EC 2.5.1.15) |
| 771 | 772 | RXA02024 | GR00613 | 4026 | 4784 | DIHYDROPTEROATE SYNTHASE (EC 2.5.1.15) |
| 773 | 774 | RXA01719 | GR00488 | 1264 | 704 | MOLYBDOPTERIN-GUANINE DINUCLEOTIDE BIOSYNTHESIS PROTEIN A |
| 775 | 776 | RXA01720 | GR00488 | 2476 | 1268 | MOLYBDOPTERIN BIOSYNTHESIS MOEA PROTEIN |
| 777 | 778 | RXS03223 | | | | MOLYBDOPTERIN BIOSYNTHESIS MOEA PROTEIN |
| 779 | 780 | F RXA01970 | GR00568 | 2 | 1207 | MOLYBDOPTERIN BIOSYNTHESIS MOEA PROTEIN |
| 781 | 782 | RXA02629 | GR00748 | 1274 | 690 | MOLYBDOPTERIN BIOSYNTHESIS CNX1 PROTEIN |
| 783 | 784 | RXA02318 | GR00665 | 9684 | 9962 | (D90909) pterin-4a-carbinolamine dehydratase [*Synechocystis* sp.] |
| 785 | 786 | RXA01517 | GR00424 | 22752 | 23228 | 2-AMINO-4-HYDROXY-6-HYDROXYMETHYLDIHYDROPTERIDINE PYROPHOSPHOKINASE (EC 2.7.6.3) |
| 787 | 788 | RXN01304 | VV0148 | 4449 | 4934 | MOLYBDOPTERIN BIOSYNTHESIS MOG PROTEIN |
| 789 | 790 | RXS02556 | | | | FLAVOHEMOPROTEIN/DIHYDROPTERIDINE REDUCTASE (EC 1.6.99.7) |
| 791 | 792 | RXS02560 | | | | OXYGEN-INSENSITIVE NAD(P)H NITROREDUCTASE (EC 1.-.-.-)/ DIHYDROPTERIDINE REDUCTASE (EC 1.6.99.7) |
| | | | | | | Vitamin $B_{12}$, porphyrins and heme metabolism |
| 793 | 794 | RXA00382 | GR00082 | 2752 | 1451 | GLUTAMATE-1-SEMIALDEHYDE 2,1-AMINOMUTASE (EC 5.4.3.8) |
| 795 | 796 | RXA00156 | GR00023 | 10509 | 9400 | FERROCHELATASE (EC 4.99.1.1) |
| 797 | 798 | RXA00624 | GR00163 | 7910 | 8596 | FERROCHELATASE (EC 4.99.1.1) |
| 799 | 800 | RXA00306 | GR00051 | 2206 | 1274 | HEMK PROTEIN |
| 801 | 802 | RXA00884 | GR00242 | 10137 | 11276 | OXYGEN-INDEPENDENT COPROPORPHYRINOGEN III OXIDASE (EC 1.-.-.-) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 803 | 804 | RXN02503 | VV0007 | 22456 | 22854 | PORPHOBILINOGEN DEAMINASE (EC 4.3.1.8) |
| 805 | 806 | F RXA02503 | GR00720 | 16906 | 17340 | PORPHOBILINOGEN DEAMINASE (EC 4.3.1.8) |
| 807 | 808 | RXA00377 | GR00081 | 1427 | 306 | UROPORPHYRINOGEN DECARBOXYLASE (EC 4.1.1.37) |
| 809 | 810 | RXN02504 | VV0007 | 22805 | 23362 | PORPHOBILINOGEN DEAMINASE (EC 4.3.1.8) |
| 811 | 812 | F RXA02504 | GR00720 | 17379 | 17816 | PORPHOBILINOGEN DEAMINASE (EC 4.3.1.8) |
| 813 | 814 | RXN01162 | VV0088 | 1849 | 524 | PRECORRIN-6Y METHYLASE (EC 2.1.1.-) |
| 815 | 816 | F RXA01162 | GR00330 | 1248 | 4 | PRECORRIN-6Y METHYLASE (EC 2.1.1.-) |
| 817 | 818 | RXA01692 | GR00474 | 1498 | 749 | UROPORPHYRIN-III C-METHYLTRANSFERASE (EC 2.1.1.107) |
| 819 | 820 | RXN00371 | VV0226 | 4180 | 5973 | UROPORPHYRIN-III C-METHYLTRANSFERASE (EC 2.1.1.107)/ UROPORPHYRINOGEN-III SYNTHASE (EC 4.2.1.75) |
| 821 | 822 | F RXA00371 | GR00078 | 929 | 6 | UROPORPHYRIN-III C-METHYLTRANSFERASE (EC 2.1.1.107)/ UROPORPHYRINOGEN-III SYNTHASE (EC 4.2.1.75) |
| 823 | 824 | F RXA00374 | GR00079 | 1102 | 371 | UROPORPHYRIN-III C-METHYLTRANSFERASE (EC 2.1.1.107)/ UROPORPHYRINOGEN-III SYNTHASE (EC 4.2.1.75) |
| 825 | 826 | RXN00383 | VV0223 | 4206 | 2863 | PROTOPORPHYRINOGEN OXIDASE (EC 1.3.3.4) |
| 827 | 828 | F RXA00376 | GR00081 | 287 | 6 | PROTOPORPHYRINOGEN OXIDASE (EC 1.3.3.4) |
| 829 | 830 | F RXA00383 | GR00082 | 3876 | 2863 | PROTOPORPHYRINOGEN OXIDASE (EC 1.3.3.4) |
| 831 | 832 | RXA01253 | GR00365 | 2536 | 1787 | COBYRIC ACID SYNTHASE |
| 833 | 834 | RXA02134 | GR00639 | 1721 | 801 | COBALAMIN (5'-PHOSPHATE) SYNTHASE |
| 835 | 836 | RXA02135 | GR00639 | 2809 | 1736 | NICOTINATE-NUCLEOTIDE-DIMETHYLBENZIMIDAZOLE PHOSPHORIBOSYLTRANSFERASE (EC 2.4.2.21) |
| 837 | 838 | RXA02136 | GR00639 | 3362 | 2841 | COBINAMIDE KINASE/COBINAMIDE PHOSPHATE GUANYLYLTRANSFERASE |
| 839 | 840 | RXN03114 | VV0088 | 1 | 552 | COBG PROTEIN (EC 1.-.-.-) |
| 841 | 842 | RXN01810 | VV0082 | 1739 | 663 | HEMIN-BINDING PERIPLASMIC PROTEIN HMUT PRECURSOR |
| 843 | 844 | RXS03205 | | | | HEMK PROTEIN |
| 845 | 846 | F RXA00306 | | | | HEMK PROTEIN |
| 847 | 848 | RXC01715 | | | | CYTOSOLIC PROTEIN INVOLVED IN PORPHYRIN METABOLISM |
| | | | | | | Vitamin C precursors |
| 849 | 850 | RXN00420 | VV0112 | 2511 | 1048 | L-GULONOLACTONE OXIDASE (EC 1.1.3.8) |
| 851 | 852 | F RXA00420 | GR00096 | 2 | 541 | L-GULONOLACTONE OXIDASE (EC 1.1.3.8) |
| 853 | 854 | F RXA00426 | GR00097 | 1737 | 2258 | L-GULONOLACTONE OXIDASE (EC 1.1.3.8) |
| 855 | 856 | RXN00708 | VV0005 | 4678 | 3872 | 2,5-DIKETO-D-GLUCONIC ACID REDUCTASE (EC 1.1.1.-) |
| 857 | 858 | F RXA00708 | GR00185 | 2030 | 1359 | 2,5-DIKETO-D-GLUCONIC ACID REDUCTASE (EC 1.1.1.-) |
| 859 | 860 | RXA02373 | GR00688 | 1540 | 626 | 2,5-DIKETO-D-GLUCONIC ACID REDUCTASE (EC 1.1.1.-) |
| 861 | 862 | RXS00389 | | | | oxoglutarate semialdehyde dehydrogenase (EC 1.2.1.-) |
| 863 | 864 | RXS00419 | | | | ACETOACETYL-COA REDUCTASE (EC 1.1.1.36) |
| 865 | 866 | RXC00416 | | | | MEMBRANE SPANNING PROTEIN INVOLVED IN METABOLISM OF VITAMIN C PRECURSORS |
| 867 | 868 | RXC02206 | | | | OXIDOREDUCTASE INVOLVED IN METABOLISM OF VITAMIN C PRECURSORS |
| | | | | | | Vitamin K2 |
| 869 | 870 | RXS03074 | | | | S-ADENOSYLMETHIONINE: 2-DEMETHYLMENAQUINONE METHYLTRANSFERASE (EC 2.1.-.-) |
| 871 | 872 | F RXA02906 | GR10044 | 1142 | 645 | S-ADENOSYLMETHIONINE: 2-DEMETHYLMENAQUINONE METHYLTRANSFERASE (EC 2.1.-.-) |
| 873 | 874 | RXA02315 | GR00665 | 8011 | 6383 | 2-SUCCINYL-6-HYDROXY-2,4-CYCLOHEXADIENE-1-CARBOXYLATE SYNTHASE/2-OXOGLUTARATE DECARBOXYLASE (EC 4.1.1.71) |
| 875 | 876 | RXA02319 | GR00665 | 9977 | 10933 | NAPHTHOATE SYNTHASE (EC 4.1.3.36) |
| 877 | 878 | RXS00393 | | | | 1,4-DIHYDROXY-2-NAPHTHOATE OCTAPRENYLTRANSFERASE (EC 2.5.-.-) |
| 879 | 880 | F RXA00393 | GR00086 | 4030 | 4911 | 1,4-DIHYDROXY-2-NAPHTHOATE OCTAPRENYLTRANSFERASE (EC 2.5.-.-) |
| 881 | 882 | RXA00391 | GR00086 | 2031 | 2750 | O-SUCCINYLBENZOIC ACID-COA LIGASE (EC 6.2.1.26) |
| 883 | 884 | RXS02908 | | | | O-SUCCINYLBENZOIC ACID-COA LIGASE (EC 6.2.1.26) |
| | | | | | | Ubiquinone biosynthesis |
| 885 | 886 | RXA00997 | GR00283 | 2389 | 1808 | 3-DEMETHYLUBIQUINONE-9 3-METHYLTRANSFERASE (EC 2.1.1.64) |
| 887 | 888 | RXA02189 | GR00642 | 986 | 249 | 3-DEMETHYLUBIQUINONE-9 3-METHYLTRANSFERASE (EC 2.1.1.64) |
| 889 | 890 | RXA02311 | GR00665 | 3073 | 2384 | 3-DEMETHYLUBIQUINONE-9 3-METHYLTRANSFERASE (EC 2.1.1.64) |
| 891 | 892 | RXN02912 | VV0135 | 13299 | 12547 | UBIQUINONE/MENAQUINONE BIOSYNTHESIS METHYLTRANSFERASE UBIE (EC 2.1.1.-) |
| 893 | 894 | RXS00998 | | | | COMA OPERON PROTEIN 2 |
| | | | | | | Purines and Pyrimidines and other Nucleotides |
| | | | | | | Regulation of purine and pyrimidine biosynthesis pathways |
| | | | | | | Purine metabolism |
| | | | | | | Purine Biosynthesis |
| 895 | 896 | RXA01215 | GR00352 | 1187 | 213 | RIBOSE-PHOSPHATE PYROPHOSPHOKINASE, PRPP synthetase (EC 2.7.6.1) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 897 | 898 | RXN00558 | VV0103 | 8235 | 9581 | AMIDOPHOSPHORIBOSYLTRANSFERASE (EC 2.4.2.14) |
| 899 | 900 | F RXA00558 | GR00148 | 61 | 501 | AMIDOPHOSPHORIBOSYLTRANSFERASE (EC 2.4.2.14) |
| 901 | 902 | RXN00626 | VV0135 | 11624 | 10362 | PHOSPHORIBOSYLAMINE-GLYCINE LIGASE (EC 6.3.4.13) |
| 903 | 904 | F RXA00629 | GR00165 | 1450 | 1713 | PHOSPHORIBOSYLAMINE-GLYCINE LIGASE (EC 6.3.4.13) |
| 905 | 906 | F RXA00626 | GR00164 | 1 | 780 | PHOSPHORIBOSYLAMINE-GLYCINE LIGASE, GARS (EC 6.3.4.13) |
| 907 | 908 | RXA02623 | GR00746 | 4875 | 4285 | PHOSPHORIBOSYLAMINE-GLYCINE LIGASE (EC 6.3.4.13)/PHOSPHORIBOSYLFORMYLGLYCINAMIDINE CYCLO-LIGASE (EC 6.3.3.1)/PHOSPHORIBOSYLGLYCINAMIDE FORMYLTRANSFERASE (EC 2.1.2.2) |
| 909 | 910 | RXA01442 | GR00418 | 10277 | 9054 | PHOSPHORIBOSYLGLYCINAMIDE FORMYLTRANSFERASE 2 (EC 2.1.2.-) |
| 911 | 912 | RXN00537 | VV0103 | 3351 | 5636 | PHOSPHORIBOSYLFORMYLGLYCINAMIDINE SYNTHASE (EC 6.3.5.3) |
| 913 | 914 | F RXA02805 | GR00786 | 54 | 638 | PHOSPHORIBOSYLFORMYLGLYCINAMIDINE SYNTHASE (EC 6.3.5.3) |
| 915 | 916 | F RXA00537 | GR00138 | 23 | 697 | PHOSPHORIBOSYLFORMYLGLYCINAMIDINE SYNTHASE (EC 6.3.5.3) |
| 917 | 918 | F RXA00561 | GR00150 | 2 | 280 | PHOSPHORIBOSYLFORMYLGLYCINAMIDINE SYNTHASE (EC 6.3.5.3) |
| 919 | 920 | RXA00541 | GR00139 | 2269 | 2937 | PHOSPHORIBOSYLFORMYLGLYCINAMIDINE SYNTHASE (EC 6.3.5.3) |
| 921 | 922 | RXA00620 | GR00163 | 3049 | 3939 | PHOSPHORIBOSYLAMIDOIMIDAZOLE-SUCCINOCARBOXAMIDE SYNTHASE (EC 6.3.2.6) |
| 923 | 924 | RXN00770 | VV0103 | 9614 | 10783 | PHOSPHORIBOSYLFORMYLGLYCINAMIDINE CYCLO-LIGASE (EC 6.3.3.1) |
| 925 | 926 | F RXA00557 | GR00147 | 15 | 818 | PHOSPHORIBOSYLFORMYLGLYCINAMIDINE CYCLO-LIGASE (EC 6.3.3.1) |
| 927 | 928 | F RXA00770 | GR00204 | 7809 | 7495 | PHOSPHORIBOSYLFORMYLGLYCINAMIDINE CYCLO-LIGASE (EC 6.3.3.1) |
| 929 | 930 | RXN02345 | VV0078 | 4788 | 5984 | PHOSPHORIBOSYLAMINOIMIDAZOLE CARBOXYLASE ATPASE SUBUNIT (EC 4.1.1.21) |
| 931 | 932 | F RXA02345 | GR00676 | 1534 | 725 | PHOSPHORIBOSYLAMINOIMIDAZOLE CARBOXYLASE ATPASE SUBUNIT (EC 4.1.1.21) |
| 933 | 934 | RXN02350 | VV0078 | 8369 | 8863 | PHOSPHORIBOSYLAMINOIMIDAZOLE CARBOXYLASE CATALYTIC SUBUNIT (EC 4.1.1.21) |
| 935 | 936 | F RXA02346 | GR00677 | 127 | 5 | PHOSPHORIBOSYLAMINOIMIDAZOLE CARBOXYLASE CATALYTIC SUBUNIT (EC 4.1.1.21) |
| 937 | 938 | F RXA02350 | GR00678 | 1120 | 911 | PHOSPHORIBOSYLAMINOIMIDAZOLE CARBOXYLASE CATALYTIC SUBUNIT (EC 4.1.1.21) |
| 939 | 940 | RXA01087 | GR00304 | 498 | 1373 | PHOSPHORIBOSYLAMINOIMIDAZOLE CARBOXYLASE (EC 4.1.1.21) |
| 941 | 942 | RXA00619 | GR00163 | 793 | 2220 | ADENYLOSUCCINATE LYASE (EC 4.3.2.2) |
| 943 | 944 | RXA02622 | GR00746 | 4274 | 2715 | PHOSPHORIBOSYLAMINOIMIDAZOLECARBOXAMIDE FORMYLTRANSFERASE (EC 2.1.2.3)/IMP CYCLOHYDROLASE (EC 3.5.4.10) |
| GMP, GDP, AMP and ADP synthesis, from inosine-5'-monophosphate (IMP) | | | | | | |
| 945 | 946 | RXN00488 | VV0086 | 19066 | 20583 | INOSINE-5'-MONOPHOSPHATE DEHYDROGENASE (EC 1.1.1.205) |
| 947 | 948 | F RXA00492 | GR00122 | 1171 | 1644 | INOSINE-5'-MONOPHOSPHATE DEHYDROGENASE (EC 1.1.1.205) |
| 949 | 950 | F RXA00488 | GR00121 | 1 | 534 | INOSINE-5'-MONOPHOSPHATE DEHYDROGENASE (EC 1.1.1.205) |
| 951 | 952 | RXA02469 | GR00715 | 1927 | 497 | INOSINE-5'-MONOPHOSPHATE DEHYDROGENASE (EC 1.1.1.205) |
| 953 | 954 | RXN00487 | VV0086 | 23734 | 25302 | GMP SYNTHASE [GLUTAMINE-HYDROLYZING] (EC 6.3.5.2) |
| 955 | 956 | F RXA00487 | GR00120 | 712 | 2097 | GMP SYNTHASE (EC 6.3.4.1) |
| 957 | 958 | RXA02237 | GR00654 | 4577 | 5146 | GUANYLATE KINASE (EC 2.7.4.8) |
| 959 | 960 | RXA01446 | GR00418 | 17765 | 16476 | ADENYLOSUCCINATE SYNTHETASE (EC 6.3.4.4) |
| 961 | 962 | RXA00619 | GR00163 | 793 | 2220 | ADENYLOSUCCINATE LYASE (EC 4.3.2.2) |
| 963 | 964 | RXA00688 | GR00179 | 10443 | 10985 | ADENYLATE KINASE (EC 2.7.4.3) |
| 965 | 966 | RXA00266 | GR00040 | 3769 | 3362 | NUCLEOSIDE DIPHOSPHATE KINASE (EC 2.7.4.6) |
| GMP/AMP degrading activities | | | | | | |
| 967 | 968 | RXA00489 | GR00121 | 654 | 1775 | GMP REDUCTASE (EC 1.6.6.8) |
| 969 | 970 | RXN02281 | VV0152 | 1893 | 3323 | AMP NUCLEOSIDASE (EC 3.2.2.4) |
| 971 | 972 | F RXA02281 | GR00659 | 1101 | 34 | AMP NUCLEOSIDASE (EC 3.2.2.4) |
| Pyrimidine metabolism | | | | | | |
| Pyrimidine biosynthesis de novo: | | | | | | |
| 973 | 974 | RXA00147 | GR00022 | 9722 | 10900 | CARBAMOYL-PHOSPHATE SYNTHASE SMALL CHAIN (EC 6.3.5.5) |
| 975 | 976 | RXA00145 | GR00022 | 7258 | 8193 | ASPARTATE CARBAMOYLTRANSFERASE CATALYTIC CHAIN (EC 2.1.3.2) |
| 977 | 978 | RXA00146 | GR00022 | 8249 | 9589 | DIHYDROOROTASE (EC 3.5.2.3) |
| 979 | 980 | RXA02208 | GR00647 | 2 | 1003 | DIHYDROOROTATE DEHYDROGENASE (EC 1.3.3.1) |
| 981 | 982 | RXA01660 | GR00462 | 591 | 1142 | OROTATE PHOSPHORIBOSYLTRANSFERASE (EC 2.4.2.10) |
| 983 | 984 | RXA02235 | GR00654 | 3207 | 4040 | OROTIDINE 5'-PHOSPHATE DECARBOXYLASE (EC 4.1.1.23) |
| 985 | 986 | RXN01892 | VV0150 | 3020 | 3748 | URIDYLATE KINASE (EC 2.7.4.-) |
| 987 | 988 | F RXA01892 | GR00542 | 47 | 775 | URIDYLATE KINASE (EC 2.7.4.-) |
| 989 | 990 | RXA00105 | GR00014 | 16672 | 17346 | THYMIDYLATE SYNTHASE (EC 2.1.1.45) |
| 991 | 992 | RXA00131 | GR00020 | 7621 | 7013 | THYMIDYLATE KINASE (EC 2.7.4.9) |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| 993 | 994 | RXA00266 | GR00040 | 3769 | 3362 | NUCLEOSIDE DIPHOSPHATE KINASE (EC 2.7.4.6) |
| 995 | 996 | RXA00718 | GR00188 | 4576 | 5283 | CYTIDYLATE KINASE (EC 2.7.4.14) |
| 997 | 998 | RXA01599 | GR00447 | 8780 | 10441 | CTP SYNTHASE (EC 6.3.4.2) |
| 999 | 1000 | RXN02234 | VV0134 | 24708 | 28046 | CARBAMOYL-PHOSPHATE SYNTHASE LARGE CHAIN (EC 6.3.5.5) |
| 1001 | 1002 | F RXA02234 | GR00654 | 1 | 3198 | CARBAMOYL-PHOSPHATE SYNTHASE LARGE CHAIN (EC 6.3.5.5) |
| 1003 | 1004 | RXN00450 | VV0112 | 34491 | 34814 | CYTOSINE DEAMINASE (EC 3.5.4.1) |
| 1005 | 1006 | F RXA00450 | GR00110 | 322 | 5 | CYTOSINE DEAMINASE (EC 3.5.4.1) |
| 1007 | 1008 | RXN02272 | VV0020 | 15566 | 16810 | CYTOSINE DEAMINASE (EC 3.5.4.1) |
| 1009 | 1010 | F RXA02272 | GR00655 | 6691 | 7935 | CREATININE DEAMINASE (EC 3.5.4.21) |
| 1011 | 1012 | RXN03004 | VV0237 | 1862 | 2341 | DEOXYCYTIDINE TRIPHOSPHATE DEAMINASE (EC 3.5.4.13) |
| 1013 | 1014 | RXN03137 | VV0129 | 9680 | 9579 | THYMIDYLATE SYNTHASE (EC 2.1.1.45) |
| 1015 | 1016 | RXN03171 | VV0328 | 568 | 1080 | URACIL PHOSPHORIBOSYLTRANSFERASE (EC 2.4.2.9) |
| 1017 | 1018 | F RXA02857 | GR10003 | 570 | 1082 | URACIL PHOSPHORIBOSYLTRANSFERASE (EC 2.4.2.9) |
| | | | | | | Purine and pyrimidine base, nucleoside and nucleotide salvage, interconversion, reduction and degradation: Purines: |
| 1019 | 1020 | RXA02771 | GR00772 | 1329 | 1883 | ADENINE PHOSPHORIBOSYLTRANSFERASE (EC 2.4.2.7) |
| 1021 | 1022 | RXA01512 | GR00424 | 17633 | 18232 | HYPOXANTHINE-GUANINE PHOSPHORIBOSYLTRANSFERASE (EC 2.4.2.8) |
| 1023 | 1024 | RXA02031 | GR00618 | 3820 | 3347 | XANTHINE-GUANINE PHOSPHORIBOSYLTRANSFERASE (EC 2.4.2.22) |
| 1025 | 1026 | RXA00981 | GR00276 | 3388 | 4017 | GTP PYROPHOSPHOKINASE (EC 2.7.6.5) |
| 1027 | 1028 | RXN02772 | VV0171 | 2045 | 1011 | GUANOSINE-3',5'-BIS(DIPHOSPHATE) 3'-PYROPHOSPHOHYDROLASE (EC 3.1.7.2) |
| 1029 | 1030 | F RXA02772 | GR00772 | 1962 | 2741 | GUANOSINE-3',5'-BIS(DIPHOSPHATE) 3'-PYROPHOSPHOHYDROLASE (EC 3.1.7.2) |
| 1031 | 1032 | F RXA02773 | GR00772 | 2741 | 2902 | GUANOSINE-3',5'-BIS(DIPHOSPHATE) 3'-PYROPHOSPHOHYDROLASE (EC 3.1.7.2) |
| 1033 | 1034 | RXA01835 | GR00517 | 3147 | 3677 | GUANOSINE-3',5'-BIS(DIPHOSPHATE) 3'-PYROPHOSPHOHYDROLASE (EC 3.1.7.2) |
| 1035 | 1036 | RXA01483 | GR00422 | 19511 | 18240 | DEOXYGUANOSINETRIPHOSPHATE TRIPHOSPHOHYDROLASE (EC 3.1.5.1) |
| 1037 | 1038 | RXN01027 | VV0143 | 5761 | 6768 | DIADENOSINE 5',5'''-P1,P4-TETRAPHOSPHATE HYDROLASE (EC 3.6.1.17) |
| 1039 | 1040 | F RXA01024 | GR00293 | 661 | 5 | DIADENOSINE 5',5'''-P1,P4-TETRAPHOSPHATE HYDROLASE (EC 3.6.1.17) |
| 1041 | 1042 | F RXA01027 | GR00294 | 2580 | 2347 | DIADENOSINE 5',5'''-P1,P4-TETRAPHOSPHATE HYDROLASE (EC 3.6.1.17) |
| 1043 | 1044 | RXA01528 | GR00425 | 5653 | 5126 | DIADENOSINE 5',5'''-P1,P4-TETRAPHOSPHATE HYDROLASE (EC 3.6.1.17) |
| 1045 | 1046 | RXA00072 | GR00012 | 446 | 6 | PHOSPHOADENOSINE PHOSPHOSULFATE REDUCTASE (EC 1.8.99.4) |
| 1047 | 1048 | RXA01878 | GR00537 | 1239 | 2117 | DIMETHYLADENOSINE TRANSFERASE (EC 2.1.1.-) |
| 1049 | 1050 | RXN02281 | VV0152 | 1893 | 3323 | AMP NUCLEOSIDASE (EC 3.2.2.4) |
| 1051 | 1052 | F RXA02281 | GR00659 | 1101 | 34 | AMP NUCLEOSIDASE (EC 3.2.2.4) |
| 1053 | 1054 | RXN01240 | VV0090 | 30442 | 29420 | GTP PYROPHOSPHOKINASE (EC 2.7.6.5) |
| 1055 | 1056 | RXN02008 | VV0171 | 1138 | 5 | GUANOSINE-3',5'-BIS(DIPHOSPHATE) 3'-PYROPHOSPHOHYDROLASE (EC 3.1.7.2) |
| | | | | | | Pyrimdine and purine metabolism: |
| 1057 | 1058 | RXN01940 | VV0120 | 10268 | 9333 | INOSINE-URIDINE PREFERRING NUCLEOSIDE HYDROLASE (EC 3.2.2.1) |
| 1059 | 1060 | F RXA01940 | GR00557 | 3 | 581 | INOSINE-URIDINE PREFERRING NUCLEOSIDE HYDROLASE (EC 3.2.2.1) |
| 1061 | 1062 | RXA02559 | GR00731 | 5418 | 6320 | INOSINE-URIDINE PREFERRING NUCLEOSIDE HYDROLASE (EC 3.2.2.1) |
| 1063 | 1064 | RXA02497 | GR00720 | 10059 | 10985 | EXOPOLYPHOSPHATASE (EC 3.6.1.11) |
| 1065 | 1066 | RXN01079 | VV0084 | 38084 | 35982 | RIBONUCLEOSIDE-DIPHOSPHATE REDUCTASE ALPHA CHAIN (EC 1.17.4.1) |
| 1067 | 1068 | F RXA01079 | GR00301 | 693 | 4 | RIBONUCLEOSIDE-DIPHOSPHATE REDUCTASE ALPHA CHAIN (EC 1.17.4.1) |
| 1069 | 1070 | F RXA01084 | GR00302 | 3402 | 2062 | RIBONUCLEOSIDE-DIPHOSPHATE REDUCTASE ALPHA CHAIN (EC 1.17.4.1) |
| 1071 | 1072 | RXN01920 | VV0084 | 32843 | 31842 | RIBONUCLEOSIDE-DIPHOSPHATE REDUCTASE 2 BETA CHAIN (EC 1.17.4.1) |
| 1073 | 1074 | F RXA01920 | GR00550 | 1321 | 908 | RIBONUCLEOTIDE REDUCTASE SUBUNIT R2F |
| 1075 | 1076 | RXA01080 | GR00301 | 1240 | 797 | NRDI PROTEIN |
| 1077 | 1078 | RXA00867 | GR00237 | 1 | 627 | POLYRIBONUCLEOTIDE NUCLEOTIDYLTRANSFERASE (EC 2.7.7.8) |
| 1079 | 1080 | RXA01416 | GR00413 | 2 | 631 | POLYRIBONUCLEOTIDE NUCLEOTIDYLTRANSFERASE (EC 2.7.7.8) |
| 1081 | 1082 | RXA01486 | GR00423 | 660 | 4 | POLYRIBONUCLEOTIDE NUCLEOTIDYLTRANSFERASE (EC 2.7.7.8) |
| 1083 | 1084 | RXA01678 | GR00467 | 7162 | 7689 | 2',3'-CYCLIC-NUCLEOTIDE 2'-PHOSPHODIESTERASE (EC 3.1.4.16) |
| 1085 | 1086 | RXA01679 | GR00467 | 7729 | 8964 | 2',3'-CYCLIC-NUCLEOTIDE 2'-PHOSPHODIESTERASE (EC 3.1.4.16) |
| 1087 | 1088 | RXN01488 | VV0139 | 39842 | 40789 | INOSINE-URIDINE PREFERRING NUCLEOSIDE HYDROLASE |

TABLE 1-continued

Included Genes

| Nucleic Acid SEQ ID NO | Amino Acid SEQ ID NO | Identification Code | Contig. | NT Start | NT Stop | Function |
|---|---|---|---|---|---|---|
| | | | | | | (EC 3.2.2.1) |
| 1089 | 1090 | RXC00540 | | | | CYTOSOLIC PROTEIN INVOLVED IN PURINE METABOLISM |
| 1091 | 1092 | RXC00560 | | | | PROTEIN INVOLVED IN PURINE METABOLISM |
| 1093 | 1094 | RXC01088 | | | | CYTOSOLIC PROTEIN INVOLVED IN PURINE METABOLISM |
| 1095 | 1096 | RXC02624 | | | | MEMBRANE SPANNING PROTEIN INVOLVED IN PURINE METABOLISM |
| 1097 | 1098 | RXC02665 | | | | PROTEIN INVOLVED IN PURINE METABOLISM |
| 1099 | 1100 | RXC02770 | | | | LIPOPROTEIN INVOLVED IN PURINE METABOLISM |
| 1101 | 1102 | RXC02238 | | | | PROTEIN INVOLVED IN METABOLISM OF S-ADENOSYLMETHIONINE, PURINES AND PANTOTHENATE |
| 1103 | 1104 | RXC01946 | | | | ABC TRANSPORTER ATP-BINDING PROTEIN INVOLVED IN PURINE METABOLISM |
| | | | | | | Pyrimdines: |
| 1105 | 1106 | RXN03171 | VV0328 | 568 | 1080 | URACIL PHOSPHORIBOSYLTRANSFERASE (EC 2.4.2.9) |
| 1107 | 1108 | F RXA02857 | GR10003 | 570 | 1082 | URACIL PHOSPHORIBOSYLTRANSFERASE (EC 2.4.2.9) |
| 1109 | 1110 | RXN00450 | VV0112 | 34491 | 34814 | CYTOSINE DEAMINASE (EC 3.5.4.1) |
| 1111 | 1112 | F RXA00450 | GR00110 | 322 | 5 | CYTOSINE DEAMINASE (EC 3.5.4.1) |
| 1113 | 1114 | RXA00465 | GR00117 | 337 | 828 | CYTOSINE DEAMINASE (EC 3.5.4.1) |
| 1115 | 1116 | RXA00717 | GR00188 | 3617 | 4576 | RIBOSOMAL LARGE SUBUNIT PSEUDOURIDINE SYNTHASE B (EC 4.2.1.70) |
| 1117 | 1118 | RXA01894 | GR00542 | 1622 | 2476 | PHOSPHATIDATE CYTIDYLYLTRANSFERASE (EC 2.7.7.41) |
| 1119 | 1120 | RXA02536 | GR00726 | 8581 | 7826 | BETA-UREIDOPROPIONASE (EC 3.5.1.6) |
| 1121 | 1122 | RXN01209 | VV0270 | 1019 | 2446 | PHOSPHOMETHYLPYRIMIDINE KINASE (EC 2.7.4.7) |
| 1123 | 1124 | F RXA01209 | GR00348 | 1019 | 2446 | PHOSPHOMETHYLPYRIMIDINE KINASE (EC 2.7.4.7) |
| 1125 | 1126 | RXN01617 | VV0050 | 22187 | 22858 | PHOSPHOMETHYLPYRIMIDINE KINASE (EC 2.7.4.7) |
| 1127 | 1128 | F RXA01617 | GR00451 | 2 | 616 | PHOSPHOMETHYLPYRIMIDINE KINASE (EC 2.7.4.7) |
| 1129 | 1130 | RXC01600 | | | | CYTOSOLIC PROTEIN INVOLVED IN PYRIMIDINE METABOLISM |
| 1131 | 1132 | RXC01622 | | | | CYTOSOLIC PROTEIN INVOLVED IN PYRIMIDINE METABOLISM |
| 1133 | 1134 | RXC00128 | | | | EXPORTED PROTEIN INVOLVED IN METABOLISM OF PYRIDIMES AND ADENOSYLHOMOCYSTEINE |
| 1135 | 1136 | RXC01709 | | | | CYTOSOLIC PROTEIN INVOLVED IN PYRIMIDINE METABOLISM |
| 1137 | 1138 | RXC02207 | | | | EXPORTED PROTEIN INVOLVED IN PYRIMIDINE METABOLISM |
| | | | | | | Sugars |
| | | | | | | Trehalose |
| 1139 | 1140 | RXA00347 | GR00065 | 246 | 1013 | TREHALOSE-PHOSPHATASE (EC 3.1.3.12) |
| 1141 | 1142 | RXN01239 | VV0090 | 32921 | 30489 | maltooligosyltrehalose synthase |
| 1143 | 1144 | F RXA01239 | GR00358 | 5147 | 7579 | maltooligosyltrehalose synthase |
| 1145 | 1146 | RXA02645 | GR00751 | 714 | 2543 | maltooligosyltrehalose trehalohydrolase |
| 1147 | 1148 | RXN02355 | VV0051 | 735 | 4 | TREHALOSE/MALTOSE BINDING PROTEIN |
| 1149 | 1150 | RXN02909 | VV0135 | 38532 | 39017 | Hypothetical Trehalose-Binding Protein |
| 1151 | 1152 | RXS00349 | | | | Hypothetical Trehalose Transport Protein |
| 1153 | 1154 | RXS03183 | | | | TREHALOSE/MALTOSE BINDING PROTEIN |
| 1155 | 1156 | RXC00874 | | | | TRANSMEMBRANE PROTEIN INVOLVED IN TREHALOSE METABOLISM |

TABLE 2

GENES IDENTIFIED FROM GENBANK

| GenBank ™ Accession No. | Gene Name | Gene Function | Reference |
|---|---|---|---|
| A09073 | ppg | Phosphoenol pyruvate carboxylase | Bachmann, B. et al. "DNA fragment coding for phosphoenolpyruvat corboxylase, recombinant DNA carrying said fragment, strains carrying the recombinant DNA and method for producing L-aminino acids using said strains," Patent: EP 0358940-A 3 Mar. 21, 1990 |
| A45579, A45581, A45583, A45585, A45587 | | Threonine dehydratase | Moeckel, B. et al. "Production of L-isoleucine by means of recombinant micro-organisms with deregulated threonine dehydratase," Patent: WO 9519442-A 5 Jul. 20, 1995 |
| AB003132 | murC; ftsQ; ftsZ | | Kobayashi, M. et al. "Cloning, sequencing, and characterization of the ftsZ gene from coryneform bacteria," Biochem. Biophys. Res. Commun., 236(2): 383-388 (1997) |
| AB015023 | murC; ftsQ | | Wachi, M. et al. "A murC gene from Coryneform bacteria," Appl. Microbiol. Biotechnol., 51(2): 223-228 (1999) |
| AB018530 | dtsR | | Kimura, E. et al. "Molecular cloning of a novel gene, dtsR, which rescues the detergent sensitivity of a mutant derived from *Brevibacterium lactofermentum*," Biosci. Biotechnol. Biochem., 60(10): 1565-1570 (1996) |
| AB018531 | dtsR1; dtsR2 | D-glutamate racemase | |
| AB020624 | murI | transketolase | |
| AB023377 | tkt | Glutamine 2-oxoglutarate aminotransferase large and small subunits | |
| AB024708 | gltB; gltD | aconitase | |
| AB025424 | acn | Replication protein | |
| AB027714 | rep | Replication protein; aminoglycoside adenyltransferase | |
| AB027715 | rep; aad | N-acetylglutamate-5-semialdehyde dehydrogenase | |
| AF005242 | argC | Glutamine synthetase | |
| AF005655 | glnA | cyclase | |
| AF030405 | hisF | Argininosuccinate synthetase | |
| AF030520 | argG | Ornithine carbamoyltransferase | |
| AF031518 | argF | 3-dehydroquinate dehydratase | |
| AF036932 | aroD | Pyruvate carboxylase | |
| AF038548 | pyc | Dipeptide-binding protein; adenine phosphoribosyltransferase; GTP pyrophosphokinase | Wehmeier, L. et al. "The role of the *Corynebacterium glutamicum* rel gene in (p)ppGpp metabolism," Microbiology, 144: 1853-1862 (1998) |
| AF038651 | dciAE; apt; rel | Arginine repressor | |
| AF041436 | argR | Inositol monophosphate phosphatase | |
| AF045998 | impA | Argininosuccinate lyase | |
| AF048764 | argH | N-acetylglutamyl phosphate reductase; ornithine acetyltransferase; N-acetylglutamate kinase; acetylornithine transminase; ornithine carbamoyltransferase; arginine repressor; argininosuccinate synthase; argininosuccinate lyase | |
| AF049897 | argC; argJ; argB; argD; argF; argR; argG; argH | Enoyl-acyl carrier protein reductase | |
| AF050109 | inhA | ATP phosphoribosyltransferase | |
| AF050166 | hisG | Phosphoribosylformimino-5-amino-1-phosphoribosyl-4-imidazolecarboxamide isomerase | |
| AF051846 | hisA | Homoserine O-acetyltransferase | Park, S. et al. "Isolation and analysis of metA, a methionine biosynthetic gene encoding homoserine acetyltransferase in *Corynebacterium glutamicum*," Mol. Cells, |
| AF052652 | metA | | |

TABLE 2-continued

GENES IDENTIFIED FROM GENBANK

| GenBank™ Accession No. | Gene Name | Gene Function | Reference |
|---|---|---|---|
| AF053071 | aroB | Dehydroquinate synthetase | |
| AF060558 | hisH | Glutamine amidotransferase | |
| AF086704 | hisE | Phosphoribosyl-ATP-pyrophosphohydrolase | |
| AF114233 | aroA | 5-enolpyruvylshikimate 3-phosphate synthase | |
| AF116184 | panD | L-aspartate-alpha-decarboxylase precursor | Dusch, N. et al. "Expression of the *Corynebacterium glutamicum* panD gene encoding L-aspartate-alpha-decarboxylase leads to pantothenate overproduction in *Escherichia coli*," Appl. Environ. Microbiol.. 65(4):1530-1539 (1999) |
| AF124518 | aroD; aroE | 3-dehydroquinase; shikimate dehydrogenase | |
| AF124600 | aroC; aroK; aroB; pepQ | Chorismate synthase; shikimate kinase; 3-dehydroquinate synthase; putative cytoplasmic peptidase | |
| AF145897 | inhA | | |
| AF145898 | inhA | | |
| AJ001436 | ectP | Transport of ectoine, glycine betaine, proline | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol.., 180(22): 6005-6012 (1998) |
| AJ004934 | dapD | Tetrahydrodipicolinate succinylase (incomplete') | Wehrmann, A. et al. "Different modes of diaminopimelate synthesis and their role in cell wall integrity: A study with *Corynebacterium glutamicum*," J. Bacteriol.., 180(12): 3159-3165 (1998) |
| AJ007732 | ppc; secG; amt; ocd; soxA | Phosphoenolpyruvate-carboxylase; ?; high affinity ammonium uptake protein; putative ornithine-cyclodecarboxylase; sarcosine oxidase | |
| AJ010319 | ftsY, glnB, glnD; srp; amtP | Involved in cell division; PII protein; uridylyltransferase (uridylyl-removing particle; low affinity ammonium uptake protein | Jakoby, M. et al. "Nitrogen regulation in *Corynebacterium glutamicum*; Isolation of genes involved in biochemical characterization of corresponding enznmye; signal recognition proteins," FEMS Microbiol., 173(2): 303-310(1999) |
| AJ132968 | cat | Chloramphenicol acetoyl transferase | |
| AJ224946 | mqo | L-malate: quinone oxidoreductase | Molenaar, D. et al. "Biochemical and genetic characterization of the membrane-associated malate dehydrogenase (acceptor) from *Corynebacterium glutamicum*," Eur. J. Biochem.. 254(2): 395-403 (1998) |
| AJ238250 | ndh | NADH dehydrogenase | |
| AJ238703 | porA | Porin | Lichtinger, T. et al. "Biochemical and biophysical characterization of the cell wall porin of *Corynebacterium glutamicum*: The channel is formed by a low molecular mass polypeptide," Biochemistry, 37(43): 15024-15032 (1998) |
| D17429 | | Transposable element IS31831 | Vertes et al. "Isolation and characterization of IS31831, a transposable element from *Corynebacterium glutamicum*," Mol. Microbiol., 11(4): 739-746 (1994) |
| D84102 | odhA | 2-oxoglutarate dehydrogenase | Usuda, Y. et al. "Molecular cloning of the *Corynebacterium glutamicum* (*Brevibacterium lactofermentum* AJ12036) odhA gene encoding a novel type of 2-oxoglutarate dehydrogenase," Microbiology, 142: 3347-3354 (1996) |
| E01358 | hdh; hk | Homoserine dehydrogenase; homoserine kinase | Katsumata, R. et al. "Production of L-threonine and L-isoleucine," Patent: JP 1987232392-A 1 Oct. 12, 1987 |
| E01359 | | Upstream of the start codon of homoserine kinase gene | Katsumata, R. et al. "Production of L-threonine and L-isoleucine," Patent: JP 1987232392-A 2 Oct. 12, 1987 |
| E01375 | | Tryptophan operon | |
| E01376 | trpL; trpE | Leader peptide; anthranilate synthase | Matsui, K. et al. "Tryptophan operon, peptide and protein coded thereby, utilization of tryptophan operon gene expression and production of tryptophan," Patent: JP 1987244382-A 1 Oct. 24, 1987 |

TABLE 2-continued

GENES IDENTIFIED FROM GENBANK

| GenBank™ Accession No. | Gene Name | Gene Function | Reference |
|---|---|---|---|
| E01377 | | Promoter and operator regions of tryptophan operon | Matsui, K. et al. "Tryptophan operon, peptide and protein coded thereby, utilization of tryptophan operon gene expression and production of tryptophan," Patent: JP 1987244382-A 1 Oct. 24, 1987 |
| E03937 | | Biotin-synthase | Hatakeyama, K. et al. "DNA fragment containing gene capable of coding biotin synthetase and its utilization," Patent: JP 1992278088-A 1 Oct. 02, 1992 |
| E04040 | | Diamino pelargonic acid aminotransferase | Kohama, K. et al. "Gene coding diaminopelargonic acid aminotransferase and desthiobiotin synthetase and its utilization," Patent: JP 1992330284-A 1 Nov. 18, 1992 |
| E04041 | | Desthiobiotinsynthetase | Kohama, K. et al. "Gene coding diaminopelargonic acid aminotransferase and desthiobiotin synthetase and its utilization," Patent: JP 1992330284-A 1 Nov. 18, 1992 |
| E04307 | | Flavum aspartase | Kurusu, Y. et al. "Gene DNA coding aspartase and utilization thereof," Patent: JP 1993030977-A 1 Feb. 09, 1993 |
| E04376 | | Isocitric acid lyase | Katsumata, R. et al. "Gene manifestation controlling DNA," Patent: JP 1993056782-A 3 Mar. 09, 1993 |
| E04377 | | Isocitric acid lyase N-terminal fragment | Katsumata, R. et al. "Gene manifestation controlling DNA," Patent: JP 1993056782-A 3 Mar. 09, 1993 |
| E04484 | | Prephenate dehydratase | Sotouchi, N. et al. "Production of L-phenylalanine by fermentation," Patent: JP 1993076352-A 2 Mar. 30, 1993 |
| E05108 | | Aspartokinase | Fugono, N. et al. "Gene DNA coding Aspartokinase and its use," Patent: JP 1993184366-A 1 Jul. 27, 1993 |
| E05112 | | Dihydro-dipichorinate synthetase | Hatakeyama, K. et al. "Gene DNA coding dihydrodipicolinic acid synthetase and its use," Patent: JP 1993184371-A 1 Jul. 27, 1993 |
| E05776 | | Diaminopimelic acid dehydrogenase | Kobayashi, M. et al. "Gene DNA coding Diaminopimelic acid dehydrogenase and its use," Patent: JP 1993284970-A 1 Nov. 02, 1993 |
| E05779 | | Threonine synthase | Kohama, K. et al. "Gene DNA coding threonine synthase and its use," Patent: JP 1993284972-A 1 Nov. 02, 1993 |
| E06110 | | Prephenate dehydratase | Kikuchi, T. et al. "Production of L-phenylalanine by fermentation method," Patent: JP 1993344881-A 1 Dec. 27, 1993 |
| E06111 | | Mutated Prephenate dehydratase | Kikuchi, T. et al. "Production of L-phenylalanine by fermentation method," Patent: JP 1993344881-A 1 Dec. 27, 1993 |
| E06146 | | Acetohydroxy acid synthetase | Inui, M. et al. "Gene capable of coding Acetohydroxy acid synthetase and its use," Patent: JP 1993344893-A 1 Dec. 27, 1993 |
| E06825 | | Aspartokinase | Sugimoto, M. et al. "Mutant aspartokinase gene," patent: JP 1994062866-A 1 Mar. 08, 1994 |
| E06826 | | Mutated aspartokinase alpha subunit | Sugimoto, M. et al. "Mutant aspartokinase gene," patent: JP 1994062866-A 1 Mar. 08, 1994 |
| E06827 | | Mutated aspartokinase alpha subunit | Sugimoto, M. et al. "Mutant aspartokinase gene," patent: JP 1994062866-A 1 Mar. 08, 1994 |
| E07701 | secY | | Honno, N. et al. "Gene DNA participating in integration of membraneous protein to membrane," Patent: JP 1994169780-A 1 Jun. 21, 1994 |
| E08177 | | Aspartokinase | Sato, Y. et al. "Genetic DNA capable of coding Aspartokinase released from feedback inhibition and its utilization," Patent: JP 1994261766-A 1 Sep. 20, 1994 |
| E08178, E08179, E08180, E08181, E08182 | | Feedback inhibition-released Aspartokinase | Sato, Y. et al. "Genetic DNA capable of coding Aspartokinase released from feedback inhibition and its utilization," Patent: JP 1994261766-A 1 Sep. 20, 1994 |
| E08232 | | Acetohydroxy-acid isomeroreductase | Inui, M. et al. "Gene DNA coding acetohydroxy acid isomeroreductase," Patent: JP 1994277067-A 1 Oct. 04, 1994 |
| E08234 | secE | | Asai, Y. et al. "Gene DNA coding for translocation machinery of protein," Patent: JP 1994277073-A 1 Oct. 04, 1994 |

TABLE 2-continued

GENES IDENTIFIED FROM GENBANK

| GenBank™ Accession No. | Gene Name | Gene Function | Reference |
|---|---|---|---|
| E08643 | | FT aminotransferase and desthiobiotin synthetase promoter region | Hatakeyama, K. et al. "DNA fragment having promoter function in coryneform bacterium," Patent: JP 1995031476-A 1 Feb. 03, 1995 |
| E08646 | | Biotin synthetase | Hatakeyama, K. et al. "DNA fragment having promoter function in coryneform bacterium," Patent: JP 1995031476-A 1 Feb. 03, 1995 |
| E08649 | | Aspartase | Kohama, K. et al "DNA fragment having promoter function in coryneform bacterium," Patent: JP 1995031478-A 1 Feb. 03, 1995 |
| E08900 | | Dihydrodipicolinate reductase | Madori, M. et al. "DNA fragment containing gene coding Dihydrodipicolinate acid reductase and utilization thereof," Patent: JP 1995075578-A 1 Mar. 20, 1995 |
| E08901 | | Diaminopimelic acid decarboxylase | Madori, M. et al. "DNA fragment containing gene coding Diaminopimelic acid decarboxylase and utilization thereof," Patent: JP 1995075579-A 1 Mar. 20, 1995 |
| E12594 | | Serine hydroxymethyltransferase | Hatakeyama, K. et al. "Production of L-tryptophan," Patent: JP 1997028391-A 1 Feb. 04, 1997 |
| E12760, E12759, E12758 | | transposase | Moriya, M. et al. "Amplification of gene using artificial transposon," Patent: JP 1997070291-A Mar. 18, 1997 |
| E12764 | | Arginyl-tRNA synthetase; diaminopimelic acid decarboxylase | Moriya, M. et al. "Amplification of gene using artificial transposon," Patent: JP 1997070291-A Mar. 18, 1997 |
| E12767 | | Dihydrodipicolinic acid synthetase | Moriya, M. et al. "Amplification of gene using artificial transposon," Patent: JP 1997070291-A Mar. 18, 1997 |
| E12770 | | aspartokinase | Moriya, M. et al. "Amplification of gene using artificial transposon," Patent: JP 1997070291-A Mar. 18, 1997 |
| E12773 | | Dihydrodipicolinic acid reductase | Moriya, M. et al. "Amplification of gene using artificial transposon," Patent: JP 1997070291-A Mar. 18, 1997 |
| E13655 | | Glucose-6-phosphate dehydrogenase | Hatakeyama, K. et al. "Glucose-6-phosphate dehydrogenase and DNA capable of coding the same," Patent: JP 1997224661-A 1 Sep. 02, 1997 |
| L01508 | IlvA | Threonine dehydratase | Moeckel, B. et al. "Functional and structural analysis of the threonine dehydratase of Corynebacterium glutamicum," J. Bacteriol., 174: 8065-8072 (1992) |
| L07603 | EC 4.2.1.15 | 3-deoxy-D-arabinoheptulosonate-7-phosphate synthase | Chen, C. et al. "The cloning and nucleotide sequence of Corynebacterium glutamicum 3-deoxy-D-arabinoheptulosonate-7-phosphate synthase gene," FEMS Microbiol. Lett., 107: 223-230 (1993) |
| L09232 | IlvB; ilvN; ilvC | Acetohydroxy acid synthase large subunit; Acetohydroxy acid synthase small subunit; Acetohydroxy acid isomenoreductase | Keilhauer, C. et al. "Isoleucine synthesis in Corynebacterium glutamicum: molecular analysis of the ilvB-ilvN-ilvC operon," J. Bacteriol., 175(17): 5595-5603 (1993) |
| L18874 | PtsM | Phosphoenolpyruvate sugar phosphotransferase | Fouet, A et al. "Bacillus subtilis sucrose-specific enzyme II of the phosphotransferase system: expression in Escherichia coli and homology to enzymes II from enteric bacteria," PNAS USA, 84(24): 8773-8777 (1987); Lee, J. K. et al. "Nucleotide sequence of the gene encoding the Corynebacterium glutamicum mannose enzyme II and analyses of the deduced protein sequence," FEMS Microbiol. Lett., 119(1-2): 137-145 (1994) |
| L27123 | aceB | Malate synthase | Lee, H-S. et al. "Molecular characterization of aceB, a gene encoding malate synthase in Corynebacterium glutamicum," J. Microbiol. Biotechnol. 4(4): 256-263 (1994) |
| L27126 | | Pyruvate kinase | Jetten, M. S. et al. "Structural and functional analysis of pyruvate kinase from Corynebacterium glutamicum," Appl. Environ. Microbiol., 60(7): 2501-2507 (1994) |
| L28760 | aceA | Isocitrate lyase | |
| L35906 | dtxr | Diphtheria toxin repressor | Oguiza, J. A. et al. "Molecular cloning, DNA sequence analysis, and characterization of the Corynebacterium diphtheriae dtxR from Brevibacterium lactofermentum," J. Bacteriol., 177(2): 465-467 (1995) |

TABLE 2-continued

GENES IDENTIFIED FROM GENBANK

| GenBank™ Accession No. | Gene Name | Gene Function | Reference |
|---|---|---|---|
| M13774 | | Prephenate dehydratase | Follettie, M. T. et al. "Molecular cloning and nucleotide sequence of the *Corynebacterium glutamicum* pheA gene," J. Bacteriol., 167: 695-702 (1986) |
| M16175 | 5S rRNA | | Park, Y-H. et al. "Phylogenetic analysis of the coryneform bacteria by 5S rRNA sequences," J. Bacteriol., 169: 1801-1806 (1987) |
| M16663 | trpE | Anthranilate synthase, 5' end | Sano, K. et al. "Structure and function of the trp operon control regions of *Brevibacterium lactofermentum*, a glutamic-acid-producing bacterium," Gene, 52: 191-200 (1987) |
| M16664 | trpA | Tryptophan synthase, 3' end | Sano, K. et al. "Structure and function of the trp operon control regions of *Brevibacterium lactofermentum*, a glutamic-acid-producing bacterium," Gene, 52: 191-200 (1987) |
| M25819 | | Phosphoenolpyruvate carboxylase | O'Regan, M. et al. "Cloning and nucleotide sequence of the Phosphoenolpyruvate carboxylase-coding gene of *Corynebacterium glutamicum* ATCC13032," Gene, 77(2): 237-251 (1989) |
| M85106 | | 23S rRNA gene insertion sequence | Roller, C. et al. "Gram-positive bacteria with a high DNA G + C content are characterized by a common insertion within their 23S rRNA genes.," J. Gen. Microbiol., 138: 1167-1175 (1992) |
| M85107, M85108 | | 23S rRNA gene insertion sequence | Roller, C. et al. "Gram-positive bacteria with a high DNA G + C content are characterized by a common insertion within their 23S rRNA genes." J. Gen. Microbiol., 138: 1167-1175 (1992) |
| M89931 | aecD; brnQ; yhbw | Beta C-S lyase; branched-chain amino acid uptake carrier; hypothetical protein yhbw | Rossol, I. et al. "The *Corynebacterium glutamicum* aecD gene encodes a C-S lyase with alpha, beta-elimination activity that degrades aminoethylcysteine," J. Bacteriol., 174(9): 2968-2977 (1992) Tauch, A. et al. "Isoleucine uptake in *Corynebacterium glutamicum* ATCC 13032 is directed by the brnQ gene product," Arch. Microbiol., 169(4): 303-312 (1998) |
| S59299 | trp | Leader gene (promoter) | Herry, D. M. et al. "Cloning of the trp gene cluster from a tryptophan-hyperproducing strain of *Corynebacterium glutamicum*: identification of a mutation in the trp leader sequence." Appl. Environ. Microbiol. 59(3): 791-799 (1993) |
| U11545 | trpD | Anthranilate phosphoribosyltransferase | O'Gara, J. P. and Dunican, L. K. (1994) Complete nucleotide sequence of the *Corynebacterium glutamicum* ATCC 21850 trpD gene." Thesis, Microbiology Department, University College Galway, Ireland. |
| U13922 | cglIM; cglIR; cglIIR | Putative type II methyltransferase; putative type II restriction endonuclease; putative type I or type III restriction endonuclease | Schafer, A. et al. "Cloning and characterization of a DNA region encoding a stress-sensitive restriction system from *Corynebacterium glutamicum* ATCC 13032 and analysis of its role in intergeneric conjugation with *Escherichia coli*," J. Bacteriol., 176(23): 7309-7319 (1994); Schafer, A. et al. "The *Corynebacterium glutamicum* cglIM gene encoding a 5-cytosine in an McrBC-deficient *Escherichia coli* strain," Gene, 203(2): 95-101 (1997) |
| U14965 | recA | | |
| U31224 | ppx | | |
| U31225 | proC | L-proline: NADP+ 5-oxidoreductase | Ankri, S. et al. "Mutations in the *Corynebacterium glutamicum* proline biosynthetic pathway: A natural bypass of the proA step," J. Bacteriol.,178(15): 4412-4419 (1996) |
| U31230 | obg; proB; unkdh | ?; gamma glutamyl kinase; similar to D-isomer specific 2-hydroxyacid dehydrogenases | Ankri, S. et al. "Mutations in the *Corynebacterium glutamicum* proline biosynthetic pathway: A natural bypass of the proA step," J. Bacteriol., 178(15): 4412-4419 (1996) |
| U31281 | bioB | Biotin synthase | Serebriiskii, I. G., "Two new members of the bio B superfamily: Cloning, sequencing and expression of bio B genes of *Methylobacillus flagellatum* and *Corynebacterium glutamicum*," Gene, 175: 15-22 (1996) |
| U35023 | thtR; accBC | Thiosulfate sulfurtransferase; acyl CoA carboxylase | Jager, W. et al. "A *Corynebacterium glutamicum* gene encoding a two-domain protein similar to biotin carboxylases and biotin-carboxyl-carrier proteins," Arch. Microbiol., 166(2): 76-82 (1996) |

TABLE 2-continued

GENES IDENTIFIED FROM GENBANK

| GenBank™ Accession No. | Gene Name | Gene Function | Reference |
|---|---|---|---|
| U43535 | cmr | Multidrug resistance protein | Jager, W. et al. "A *Corynebacterium glutamicum* gene conferring multidrug resistance in the heterologous host *Escherichia coli*," J. Bacteriol., 179(7): 2449-2451 (1997) |
| U43536 | clpB | Heat shock ATP-binding protein | |
| U53387 | aphA-3 | 3'5''-aminoglycoside phosphotransferase | |
| U89648 | | *Corynebacterium glutamicum* unidentified sequence involved in histidine biosynthesis, partial sequence | |
| X04960 | trpA; trpB; trpC; trpD; trpE; trpG; trpL | Tryptophan operon | Matsui, K. et al. "Complete nucleotide and deduced amino acid sequences of the *Brevibacterium lactofermentum* tryptophan operon," Nucleic Acids Res. 14(24): 10113-10114 (1986) |
| X07563 | lys A | DAP decarboxylase (meso-diaminopimelate decarboxylase, EC 4.1.1.20) | Yeh, P. et al. "Nucleic sequence of the lysA gene of *Corynebacterium glutamicum* and possible mechanisms for modulation of its expression," Mol. Gen. Genet., 212(1): 112-119 (1988) |
| X14234 | EC 4.1.1.31 | Phosphoenolpyruvate carboxylase | Eikmanns, B. J. et al. "The Phosphoenolpyruvate carboxylase gene of *Corynebacterium glutamicum*: Molecular cloning, nucleotide sequence, and expression," Mol. Gen. Genet., 218(2): 330-339 (1989); Lepiniec, L. et al. "Sorghum Phosphoenolpyruvate carboxylase gene family: structure, function and molecular evolution," Plant. Mol. Biol., 21 (3): 487-502 (1993) |
| X17313 | fda | Fructose-bisphosphate aldolase | Von der Osten, C. H. et al. "Molecular cloning, nucleotide sequence and fine-structural analysis of the *Corynebacterium glutamicum* fda gene: structural comparison of *C. glutamicum* fructose-1, 6-biphosphate aldolase to class I and class II aldolases," Mol. Microbiol., |
| X53993 | dapA | L-2, 3-dihydrodipicolinate synthetase (EC 4.2.1.52) | Bonnassie, S. et al. "Nucleic sequence of the dapA gene from *Corynebacterium glutamicum*," Nucleic Acids Res., 18(21): 6421 (1990) |
| X54223 | | AttB-related site | Cianciotto, N. et al. "DNA sequence homology between att B-related sites of *Corynebacterium diphtheriae*, *Corynebacterium ulcerans*, *Corynebacterium glutamicum*, and the attP site of lambdacorynephage," FEMS. Microbiol, Lett., 66: 299-302 (1990) |
| X54740 | argS; lysA | Arginyl-tRNA synthetase; Diaminopimelate decarboxylase | Marcel, T. et al. "Nucleotide sequence and organization of the upstream region of the *Corynebacterium glutamicum* lysA gene," Mol. Microbiol., 4(11): 1819-1830 (1990) |
| X55994 | trpL; trpE | Putative leader peptide; anthranilate synthase component 1 | Heery, D. M. et al. "Nucleotide sequence of the *Corynebacterium glutamicum* trpE gene," Nucleic Acids Res., 18(23): 7138 (1990) |
| X56037 | thrC | Threonine synthase | Han, K. S. et al. "The molecular structure of the *Corynebacterium glutamicum* threonine synthase gene," Mol. Microbiol., 4(10): 1693-1702 (1990) |
| X56075 | attB-related site | Attachment site | Cianciotto, N. et al. "DNA sequence homology between att B-related sites of *Corynebacterium diphtheriae*, *Corynebacterium ulcerans*, *Corynebacterium glutamicum*, and the attP site of lambdacorynephage," FEMS. Microbiol, Lett., 66: 299-302 (1990) |
| X57226 | lysC-alpha; lysC-beta; asd | Aspartokinase-alpha subunit; Aspartokinase-beta subunit; aspartate beta semialdehyde dehydrogenase | Kalinowski, J. et al. "Genetic and biochemical analysis of the Aspartokinase from *Corynebacterium glutamicum*," Mol. Microbiol., 5(5): 1197-1204 (1991); Kalinowski, J. et al. "Aspartokinase genes lysC alpha and lysC beta overlap and are adjacent to the aspartate beta-semialdehyde dehydrogenase gene asd in *Corynebacterium glutamicum*," Mol. Gen. Genet., 224(3): 317-324 (1990) |
| X59403 | gap; pgk; tpi | Glyceraldehyde-3-phosphate; phosphoglycerate kinase; triosephosphate isomerase | Eikmanns, B. J. "Identification, sequence analysis, and expression of a *Corynebacterium glutamicum* gene cluster encoding the three glycolytic enzymes glyceraldehyde-3-phosphate dehydrogenase, 3-phosphoglycerate kinase, and triosephosphate isomeras," J. Bacteriol., 174(19): 6076-6086 (1992) |

TABLE 2-continued

GENES IDENTIFIED FROM GENBANK

| GenBank™ Accession No. | Gene Name | Gene Function | Reference |
|---|---|---|---|
| X59404 | gdh | Glutamate dehydrogenase | Bormann, E. R. et al. "Molecular analysis of the *Corynebacterium glutamicum* gdh gene encoding glutamate dehydrogenase," Mol. Microbiol., 6(3): 317-326 (1992) |
| X60312 | lysI | L-lysine permease | Seep-Feldhaus, A. H. et al. "Molecular analysis of the *Corynebacterium glutamicum* lysI gene involved in lysine uptake," Mol. Microbiol.. 5(12): 2995-3005 (1991) |
| X66078 | cop1 | Ps1 protein | Joliff, G. et al. "Cloning and nucleotide sequence of the csp1 gene encoding PS1, one of the two major secreted proteins of *Corynebacterium glutamicum*: The deduced N-terminal region of PS1 is similar to the Mycobacterium antigen 85 complex," Mol. Microbiol., 6(16): 2349-2362 (1992) |
| X66112 | glt | Citrate synthase | Eikmanns, B. J. et al. "Cloning sequence, expression and transcriptional analysis of the *Corynebacterium glutamicum* gltA gene encoding citrate synthase," Microbiol, 140: 1817-1828 (1994) |
| X67737 | dapB | Dihydrodipicolinate reductase | |
| X69103 | csp2 | Surface layer protein PS2 | Peyret, J.L. et al. "Characterization of the cspB gene encoding PS2, an ordered surface-layer protein in *Corynebacterium glutamicum*," Mol. Microbiol., 9(1): 97-109 (1993) |
| X69104 | | IS3 related insertion element | Bonamy, C. et al. "Identification of IS1206, a *Corynebacterium glutamicum* IS3-related insertion sequence and phylogenetic analysis," Mol. Microbiol., 14(3): 571-581 (1994) |
| X70959 | leuA | Isopropylmalate synthase | Patek, M. et al. "Leucine synthesis in *Corynebacterium glutamicum*: enzyme activities, structure of leuA, and effect of leuA inactivation on lysine synthesis," Appl. Environ. Microbiol., 60(1): 133-140 (1994) |
| X71489 | icd | Isocitrate dehydrogenase (NADP+) | Eikmanns, B. J. et al. "Cloning sequence analysis, expression, and inactivation of the *Corynebacterium glutamicum* icd gene encoding isocitrate dehydrogenase and biochemical characterization of the enzyme," J. Bacteriol., 177(3): 774-782 (1995) |
| X72855 X75083, X70584 | GDHA mtrA | Glutamate dehydrogenase (NADP+) 5-methyltryptophan resistance | Heery, D. M. et al. "A sequence from a tryptophan-hyperproducing strain of *Corynebacterium glutamicum* encoding resistance to 5-methyltryptophan," Biochem. Biophys. Res. Commun. 201(3): 1255-1262 (1994) |
| X75085 | recA | | Fitzpatrick, R. et al. "Construction and characterization of recA mutant strains of *Corynebacterium glutamicum* and *Brevibacterium lactofermentum*," Appl. Microbiol. Biotechnol., 42(4): 575-580 (1994) |
| X75504 | aceA; thiX | Partial Isocitrate lyase; ? | Reinscheid, D. J. et al. "Characterization of the isocitrate lyase gene from *Corynebacterium glutamicum* and biochemical analysis of the enzyme," J. Bacteriol. 176(12): 3474-3483 (1994) |
| X76875 | | ATPase beta-subunit | Ludwig, W. et al. "Phylogenetic relationships of bacteria based on comparative sequence analysis of elongation factor Tu and ATP-synthase beta-subunit genes," Antonie Van Leeuwenhoek, 64: 285-305 (1993) |
| X77034 | tuf | Elongation factor Tu | Ludwig, W. et al. "Phylogenetic relationships of bacteria based on comparative sequence analysis of elongation factor Tu and ATP-synthase beta-subunit genes," Antonie Van Leeuwenhoek, 64: 285-305 (1993) |
| X77384 | recA | | Billman-Jacobe, H. "Nucleotide sequence of a recA gene from *Corynebacterium glutamicum*," DNA Seq., 4(6): 403-404 (1994) |
| X78491 | aceB | Malate synthase | Reinscheid, D. J. et al. "Malate synthase from *Corynebacterium glutamicum* pta-ack operon encoding phosphotransacetylase: sequence analysis," Microbiology, 140: 3099-3108 (1994) |
| X80629 | 16S rDNA | 16S ribosomal RNA | Rainey, F. A. et al. "Phylogenetic analysis of the genera *Rhodococcus* and *Norcardia* and evidence for the evolutionary origin of the genus *Norcardia* from within the radiation of *Rhodococcus* species," Microbiol, 141: 523-528 (1995) |

TABLE 2-continued

GENES IDENTIFIED FROM GENBANK

| GenBank™ Accession No. | Gene Name | Gene Function | Reference |
|---|---|---|---|
| X81191 | gluA; gluB; gluC; gluD | Glutamate uptake system | Kronemeyer, W. et al. "Structure of the gluABCD cluster encoding the glutamate uptake system of *Corynebacterium glutamicum*," J. Bacteriol., 177(5): 1152-1158 (1995) |
| X81379 | dapE | Succinyldiaminopimelate desuccinylase | Wehmann, A. et al. "Analysis of different DNA fragments of *Corynebacterium glutamicum* complementing dapE of *Escherichia coli*," Microbiology, 40: 3349-56 (1994) |
| X82061 | 16S rDNA | 16S ribosomal RNA | Ruimy, R. et al. "Phylogeny of the genus *Corynebacterium* deduced from analyses of small-subunit ribosomal DNA sequences," Int. J. Syst. Bacteriol.. 45(4): 740-746 (1995) |
| X82928 | asd; lysC | Aspartate-semialdehyde dehydrogenase; ? | Serebrijski, I. et al. "Multicopy suppression by asd gene and osmotic stress-dependent complementation by heterologous proA in proA mutants," J. Bacteriol., 177(24): 7255-7260 (1995) |
| X82929 | proA | Gamma-glutamyl phosphate reductase | Serebrijski, I. et al. "Multicopy suppression by asd gene and osmotic stress-dependent complementation by heterologous proA in proA mutants," J. Bacteriol., 177(24): 7255-7260 (1995) |
| X84257 | 16S rDNA | 16S ribosomal RNA | Pascual, C. et al. "Phylogenetic analysis of the genus *Corynebacterium* based on 16S rRNA gene sequences," Int. J. Syst. Bacteriol., 45(4): 724-728 (1995) |
| X85965 | aroP; dapE | Aromatic amino acid permease; ? | Wehmann et al. "Functional analysis of sequences adjacent to dapE of *C. glutamicum* proline reveals the presence of aroP, which encodes the aromatic amino acid transporter," J. Bacteriol., 177(20): 5991-5993 (1995) |
| X86157 | argB; argC; argD; argF; argJ | Acetylglutamate kinase; N-acetyl-gamma-glutamyl-phosphate reductase; acetylornithine aminotransferase; ornithine carbamoyltransferase; glutamate N-acetyltransferase | Sakanyan, V. et al. "Genes and enzymes of the acetyl cycle of arginine biosynthesis in *Corynebacterium glutamicum*: enzyme evolution in the early steps of the arginine pathway," Microbiology, 142: 99-108 (1996) |
| X89084 | pta; ackA | Phosphate acetyltransferase; acetate kinase | Reinscheid, D. J. et al. "Cloning, sequence analysis, expression and inactivation of the *Corynebacterium glutamicum* pta-ack operon encoding phosphotransacetylase and acetate kinase," Microbiology, 145: 503-513 (1999) |
| X89850 | attB | Attachment site | Le Marree, C. et al. "Genetic characterization of site-specific integration functions of phi AAU2 infecting "*Arthrobacter aureus* C70," J. Bacteriol., 178(7): 1996-2004 (1996) |
| X90356 | | Promoter fragment F1 | Patek, M. et al. "Promoters from *Corynebacterium glutamicum*: cloning, molecular analysis and search for a consensus motif," Microbiology, 142: 1297-1309 (1996) |
| X90357 | | Promoter fragment F2 | Patek, M. et al. "Promoters from *Corynebacterium glutamicum*: cloning, molecular analysis and search for a consensus motif," Microbiology, 142: 1297-1309 (1996) |
| X90358 | | Promoter fragment F10 | Patek, M. et al. "Promoters from *Corynebacterium glutamicum*: cloning, molecular analysis and search for a consensus motif," Microbiology, 142: 1297-1309 (1996) |
| X90359 | | Promoter fragment F13 | Patek, M. et al. "Promoters from *Corynebacterium glutamicum*: cloning, molecular analysis and search for a consensus motif," Microbiology, 142: 1297-1309 (1996) |
| X90360 | | Promoter fragment F22 | Patek, M. et al. "Promoters from *Corynebacterium glutamicum*: cloning, molecular analysis and search for a consensus motif," Microbiology, 142: 1297-1309 (1996) |
| X90361 | | Promoter fragment F34 | Patek, M. et al. "Promoters from *Corynebacterium glutamicum*: cloning, molecular analysis and search for a consensus motif," Microbiology, 142: 1297-1309 (1996) |

TABLE 2-continued

GENES IDENTIFIED FROM GENBANK

| GenBank™ Accession No. | Gene Name | Gene Function | Reference |
|---|---|---|---|
| X90362 | | Promoter fragment F37 | Patek, M. et al. "Promoters from *C. glutamicum*: cloning, molecular analysis and search for a consensus motif," Microbiology, 142: 1297-1309 (1996) |
| X90363 | | Promoter fragment F45 | Patek, M. et al. "Promoters from *Corynebacterium glutamicum*: cloning, molecular analysis and search for a consensus motif," Microbiology, 142: 1297-1309 (1996) |
| X90364 | | Promoter fragment F64 | Patek, M. et al. "Promoters from *Corynebacterium glutamicum*: cloning, molecular analysis and search for a consensus motif," Microbiology, 142: 1297-1309 (1996) |
| X90365 | | Promoter fragment F75 | Patek, M. et al. "Promoters from *Corynebacterium glutamicum*: cloning, molecular analysis and search for a consensus motif," Microbiology, 142: 1297-1309 (1996) |
| X90366 | | Promoter fragment PF101 | Patek, M. et al. "Promoters from *Corynebacterium glutamicum*: cloning, molecular analysis and search for a consensus motif," Microbiology, 142: 1297-1309 (1996) |
| X90367 | | Promoter fragment PF104 | Patek, M. et al. "Promoters from *Corynebacterium glutamicum*: cloning, molecular analysis and search for a consensus motif," Microbiology, 142: 1297-1309 (1996) |
| X90368 | | Promoter fragment PF109 | Patek, M. et al. "Promoters from *Corynebacterium glutamicum*: cloning, molecular analysis and search for a consensus motif," Microbiology, 142: 1297-1309 (1996) |
| X93513 | amt | Ammonium transport system | Siewe, R. M. et al. "Functional and genetic characterization of the (methyl) ammonium uptake carrier of *Corynebacterium glutamicum*," J. Biol. Chem., 271(10): 5398-5403 (1996) |
| X93514 | betP | Glycine betaine transport system | Peter, H. et al. "Isolation, characterization, and expression of the *Corynebacterium glutamicum* betP gene, encoding the transport system for the compatible solute glycine betaine," J. Bacteriol., 178(17): 5229-5234 (1996) |
| X95649 | orf4 | Insertion sequence IS1207 and transposase | Patek, M. et al. "Identification and transcriptional analysis of the dapB-ORF2-dapA-ORF4 operon of *Corynebacterium glutamicum* encoding two enzymes involved in L-lysine synthesis," Biotechnol. Lett., 19: 1113-1117 (1997) |
| X96962<br>X99289 | | Elongation factor P | |
| X96471 | lysE; lysG | Lysine exporter protein; Lysine export regulator protein | Vrljic, M. et al. "A new type of transporter with a new type of cellular function: L-lysine export from *Corynebacterium glutamicum*," Mol. Microbiol., 22(5): 815-826 (1996) |
| X96580 | panB; panC; xylB | 3-methyl-2-oxobutanoate hydroxymethyltransferase; pantoate-beta-alanin ligase; xylulokinase | Sahm, H. et al. "D-pantothenate synthesis in *Corynebacterium glutamicum* and use of panBC and genes encoding L-valine synthesis for D-pantothenate overproduction," Appl. Environ. Microbiol., 65(5): 1973-1979 (1999) |
| X96962<br>X99289 | orf4 | Elongation factor P | Ramos, A. et al. "Cloning, sequencing and expression of the gene encoding elongation factor P in the amino-acid producer *Brevibacterium lactofermentum* (*Corynebacterium glutamicum* ATCC 13869)," Gene, 198: 217-222 (1997) |
| Y00140 | thrB | Homoserine kinase | Mateos, L. M. et al. "Nucleotide sequence of the homoserine kinase (thrB) gene of the *Brevibacterium lactofermentum*," Nucleic Acids Res., 15(9): 3922 (1987) |
| Y00151 | ddh | Meso-diaminopimelate D-dehydrogenase (EC 1.4.1.16) | Ishino, S. et al. "Nucleotide sequence of the meso-diaminopimelate D-dehydrogenase gene from *Corynebacterium glutamicum*," Nucleic Acids Res., 15(9): 3917 (1987) |
| Y00476 | thrA | Homoserine dehydrogenase | Mateos, L. M. et al. "Nucleotide sequence of the homoserine dehydrogenase (thrA) gene of the *Brevibacterium lactofermentum*," Nucleic Acids Res., 15(24): 10598 (1987) |

TABLE 2-continued

GENES IDENTIFIED FROM GENBANK

| GenBank™ Accession No. | Gene Name | Gene Function | Reference |
|---|---|---|---|
| Y00546 | hom; thrB | Homoserine dehydrogenase; homoserine kinase | Peoples, O. P. et al. "Nucleotide sequence and fine structural analysis of the *Corynebacterium glutamicum* hom-thrB operon," Mol. Microbiol., 2(1): 63-72 (1988) |
| Y08964 | murC; ftsQ/divD; ftsZ | UPD-N-acetylmuramate-alanine ligase; division-initiation protein or cell division protein; cell division protein | Honrubia, M. P. et al. "Identification, characterization, and chromosomal organization of the ftsZ gene from *Brevibacterium lactofermentum*," Mol. Gen. Genet., 259(1): 97-104 (1998) |
| Y09163 | putP | High affinity proline transport system | Peter, H. et al. "Isolation of the putP gene of *Corynebacterium glutamicum*:proline and characterization of a low-affinity uptake system for compatible solutes," Arch. Microbiol., 168(2): 143-151 (1997) |
| Y09548 | pyc | Pyruvate carboxylase | Peters-Wendisch, P. G. et al. "Pyruvate carboxylase from *Corynebacterium glutamicum*: characterization, expression and inactivation of the pyc gene," Microbiology, 144: 915-927 (1998) |
| Y09578 | leuB | 3-isopropylmalate dehydrogenase | Patek, M. et al. "Analysis of the leuB gene from *Corynebacterium glutamicum*," Appl. Microbiol. Biotechnol., 50(1): 42-47 (1998) |
| Y12472 | | Attachment site bacteriophage Phi-16 | Moreau, S. et al. "Site-specific integration of corynephage Phi-16: The construction of an integration vector," Microbiol., 145: 539-548 (1999) |
| Y12537 | proP | Proline/ectoine uptake system protein | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol., 180(22): 6005-6012 (1998) |
| Y13221 | glnA | Glutamine synthetase I | Jakoby, M. et al. "Isolation of *Corynebacterium glutamicum* glnA gene encoding glutamine synthetase I," FEMS Microbiol. Lett., 154(1): 81-88 (1997) |
| Y16642 | lpd | Dihydrolipoamide dehydrogenase | |
| Y18059 | | Attachment site Corynephage 304L | Moreau, S. et al. "Analysis of the integration functions of φ304L: An integrase module among corynephages,"Virology, 255(1): 150-159 (1999) |
| Z21501 | argS; lysA | Arginyl-tRNA synthetase; diaminopimelate decarboxylase (partial) | Oguiza, J. A. et al. "A gene encoding arginyl-tRNA synthetase is located in the upstream region of the lysA gene in *Brevibacterium lactofermentum*: Regulation of argS-lysA cluster expression by arginine," J. Bacteriol., 175(22): 7356-7362 (1993) |
| Z21502 | dapA; dapB | Dihydrodipicolinate synthase; dihydrodipicolinate reductase | Pisabarro, A. et al. "A cluster of three genes (dapA, orf2, and dapB) of *Brevibacterium lactofermentum* encodes dihydrodipicolinate reductase, and a third polypeptide of unknown function," J. Bacteriol., 175(9): 2743-2749 (1993) |
| Z29563 | thrC | Threonine synthase | Malumbres, M. et al. "Analysis and expression of the thrC gene of the encoded threonine synthase," Appl. Environ. Microbiol., 60(7)2209-2219 (1994) |
| Z46753 | 16S rDNA | Gene for 16S ribosomal RNA | |
| Z49822 | sigA | SigA sigma factor | Oguiza, J. A. et al "Multiple sigma factor genes in *Brevibacterium lactofermentum*: Characterization of sigA and sigB," J. Bacteriol., 178(2): 550-553 (1996) |
| Z49823 | galE; dtxR | Catalytic activity UDP-galactose 4-epimerase; diphtheria toxin regulatory protein | Oguiza, J. A. et al. "The galE gene encoding the UDP-galactose 4-epimerase of *Brevibacterium lactofermentum* is coupled transcriptionally to the dmdR gene," Gene, 177: 103-107 (1996) |
| Z49824 | orf1; sigB | ?; SigB sigma factor | Oguiza, J. A. et al "Multiple sigma factor genes in *Brevibacterium lactofermentum*: Characterization of sigA and sigB," J. Bacteriol., 178(2): 550-553 (1996) |
| Z66534 | | Transposase | Correia, A. et al. "Cloning and characterization of an IS-like element present in the genome of *Brevibacterium lactofermentum* ATCC 13869," Gene, 170(1): 91-94 (1996) |

[1] A sequence for this gene was published in the indicated reference. However, the sequence obtained by the inventors of the present application is significantly longer than the published version. It is believed that the published version relied on an incorrect start codon, and thus represents only a fragment of the actual coding region.

TABLE 3

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Brevibacterium | ammoniagenes | 21054 | | | | | | | |
| Brevibacterium | ammoniagenes | 19350 | | | | | | | |
| Brevibacterium | ammoniagenes | 19351 | | | | | | | |
| Brevibacterium | ammoniagenes | 19352 | | | | | | | |
| Brevibacterium | ammoniagenes | 19353 | | | | | | | |
| Brevibacterium | ammoniagenes | 19354 | | | | | | | |
| Brevibacterium | ammoniagenes | 19355 | | | | | | | |
| Brevibacterium | ammoniagenes | 19356 | | | | | | | |
| Brevibacterium | ammoniagenes | 21055 | | | | | | | |
| Brevibacterium | ammoniagenes | 21077 | | | | | | | |
| Brevibacterium | ammoniagenes | 21553 | | | | | | | |
| Brevibacterium | ammoniagenes | 21580 | | | | | | | |
| Brevibacterium | ammoniagenes | 39101 | | | | | | | |
| Brevibacterium | butanicum | 21196 | | | | | | | |
| Brevibacterium | divaricatum | 21792 | P928 | | | | | | |
| Brevibacterium | flavum | 21474 | | | | | | | |
| Brevibacterium | flavum | 21129 | | | | | | | |
| Brevibacterium | flavum | 21518 | | | | | | | |
| Brevibacterium | flavum | | | B11474 | | | | | |
| Brevibacterium | flavum | | | B11472 | | | | | |
| Brevibacterium | flavum | 21127 | | | | | | | |
| Brevibacterium | flavum | 21128 | | | | | | | |
| Brevibacterium | flavum | 21427 | | | | | | | |
| Brevibacterium | flavum | 21475 | | | | | | | |
| Brevibacterium | flavum | 21517 | | | | | | | |
| Brevibacterium | flavum | 21528 | | | | | | | |
| Brevibacterium | flavum | 21529 | | | | | | | |
| Brevibacterium | flavum | | | B11477 | | | | | |
| Brevibacterium | flavum | | | B11478 | | | | | |
| Brevibacterium | flavum | 21127 | | | | | | | |
| Brevibacterium | flavum | | | B11474 | | | | | |
| Brevibacterium | healii | 15527 | | | | | | | |
| Brevibacterium | ketoglutamicum | 21004 | | | | | | | |
| Brevibacterium | ketoglutamicum | 21089 | | | | | | | |
| Brevibacterium | ketosoreductum | 21914 | | | | | | | |
| Brevibacterium | lactofermentum | | | | 70 | | | | |
| Brevibacterium | lactofermentum | | | | 74 | | | | |
| Brevibacterium | lactofermentum | | | | 77 | | | | |
| Brevibacterium | lactofermentum | 21798 | | | | | | | |
| Brevibacterium | lactofermentum | 21799 | | | | | | | |
| Brevibacterium | lactofermentum | 21800 | | | | | | | |
| Brevibacterium | lactofermentum | 21801 | | | | | | | |
| Brevibacterium | lactofermentum | | | B11470 | | | | | |
| Brevibacterium | lactofermentum | | | B11471 | | | | | |
| Brevibacterium | lactofermentum | 21086 | | | | | | | |
| Brevibacterium | lactofermentum | 21420 | | | | | | | |
| Brevibacterium | lactofermentum | 21086 | | | | | | | |
| Brevibacterium | lactofermentum | 31269 | | | | | | | |
| Brevibacterium | linens | 9174 | | | | | | | |
| Brevibacterium | linens | 19391 | | | | | | | |
| Brevibacterium | linens | 8377 | | | | | | | |
| Brevibacterium | paraffinolyticum | | | | | 11160 | | | |
| Brevibacterium | spec. | | | | | | 717.73 | | |
| Brevibacterium | spec. | | | | | | 717.73 | | |
| Brevibacterium | spec. | 14604 | | | | | | | |
| Brevibacterium | spec. | 21860 | | | | | | | |
| Brevibacterium | spec. | 21864 | | | | | | | |
| Brevibacterium | spec. | 21865 | | | | | | | |
| Brevibacterium | spec. | 21866 | | | | | | | |
| Brevibacterium | spec. | 19240 | | | | | | | |
| Corynebacterium | acetoacidophilum | 21476 | | | | | | | |
| Corynebacterium | acetoacidophilum | 13870 | | | | | | | |
| Corynebacterium | acetoglutamicum | | | B11473 | | | | | |
| Corynebacterium | acetoglutamicum | | | B11475 | | | | | |
| Corynebacterium | acetoglutamicum | 15806 | | | | | | | |
| Corynebacterium | acetoglutamicum | 21491 | | | | | | | |
| Corynebacterium | acetoglutamicum | 31270 | | | | | | | |
| Corynebacterium | acetophilum | | | B3671 | | | | | |
| Corynebacterium | ammoniagenes | 6872 | | | | | | | 2399 |
| Corynebacterium | ammoniagenes | 15511 | | | | | | | |
| Corynebacterium | fujiokense | 21496 | | | | | | | |
| Corynebacterium | glutamicum | 14067 | | | | | | | |
| Corynebacterium | glutamicum | 39137 | | | | | | | |
| Corynebacterium | glutamicum | 21254 | | | | | | | |
| Corynebacterium | glutamicum | 21255 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | glutamicum | 31830 | | | | | | | |
| Corynebacterium | glutamicum | 13032 | | | | | | | |
| Corynebacterium | glutamicum | 14305 | | | | | | | |
| Corynebacterium | glutamicum | 15455 | | | | | | | |
| Corynebacterium | glutamicum | 13058 | | | | | | | |
| Corynebacterium | glutamicum | 13059 | | | | | | | |
| Corynebacterium | glutamicum | 13060 | | | | | | | |
| Corynebacterium | glutamicum | 21492 | | | | | | | |
| Corynebacterium | glutamicum | 21513 | | | | | | | |
| Corynebacterium | glutamicum | 21526 | | | | | | | |
| Corynebacterium | glutamicum | 21543 | | | | | | | |
| Corynebacterium | glutamicum | 13287 | | | | | | | |
| Corynebacterium | glutamicum | 21851 | | | | | | | |
| Corynebacterium | glutamicum | 21253 | | | | | | | |
| Corynebacterium | glutamicum | 21514 | | | | | | | |
| Corynebacterium | glutamicum | 21516 | | | | | | | |
| Corynebacterium | glutamicum | 21299 | | | | | | | |
| Corynebacterium | glutamicum | 21300 | | | | | | | |
| Corynebacterium | glutamicum | 39684 | | | | | | | |
| Corynebacterium | glutamicum | 21488 | | | | | | | |
| Corynebacterium | glutamicum | 21649 | | | | | | | |
| Corynebacterium | glutamicum | 21650 | | | | | | | |
| Corynebacterium | glutamicum | 19223 | | | | | | | |
| Corynebacterium | glutamicum | 13869 | | | | | | | |
| Corynebacterium | glutamicum | 21157 | | | | | | | |
| Corynebacterium | glutamicum | 21158 | | | | | | | |
| Corynebacterium | glutamicum | 21159 | | | | | | | |
| Corynebacterium | glutamicum | 21355 | | | | | | | |
| Corynebacterium | glutamicum | 31808 | | | | | | | |
| Corynebacterium | glutamicum | 21674 | | | | | | | |
| Corynebacterium | glutamicum | 21562 | | | | | | | |
| Corynebacterium | glutamicum | 21563 | | | | | | | |
| Corynebacterium | glutamicum | 21564 | | | | | | | |
| Corynebacterium | glutamicum | 21565 | | | | | | | |
| Corynebacterium | glutamicum | 21566 | | | | | | | |
| Corynebacterium | glutamicum | 21567 | | | | | | | |
| Corynebacterium | glutamicum | 21568 | | | | | | | |
| Corynebacterium | glutamicum | 21569 | | | | | | | |
| Corynebacterium | glutamicum | 21570 | | | | | | | |
| Corynebacterium | glutamicum | 21571 | | | | | | | |
| Corynebacterium | glutamicum | 21572 | | | | | | | |
| Corynebacterium | glutamicum | 21573 | | | | | | | |
| Corynebacterium | glutamicum | 21579 | | | | | | | |
| Corynebacterium | glutamicum | 19049 | | | | | | | |
| Corynebacterium | glutamicum | 19050 | | | | | | | |
| Corynebacterium | glutamicum | 19051 | | | | | | | |
| Corynebacterium | glutamicum | 19052 | | | | | | | |
| Corynebacterium | glutamicum | 19053 | | | | | | | |
| Corynebacterium | glutamicum | 19054 | | | | | | | |
| Corynebacterium | glutamicum | 19055 | | | | | | | |
| Corynebacterium | glutamicum | 19056 | | | | | | | |
| Corynebacterium | glutamicum | 19057 | | | | | | | |
| Corynebacterium | glutamicum | 19058 | | | | | | | |
| Corynebacterium | glutamicum | 19059 | | | | | | | |
| Corynebacterium | glutamicum | 19060 | | | | | | | |
| Corynebacterium | glutamicum | 19185 | | | | | | | |
| Corynebacterium | glutamicum | 13286 | | | | | | | |
| Corynebacterium | glutamicum | 21515 | | | | | | | |
| Corynebacterium | glutamicum | 21527 | | | | | | | |
| Corynebacterium | glutamicum | 21544 | | | | | | | |
| Corynebacterium | glutamicum | 21492 | | | | | | | |
| Corynebacterium | glutamicum | | | B8183 | | | | | |
| Corynebacterium | glutamicum | | | B8182 | | | | | |
| Corynebacterium | glutamicum | | | B12416 | | | | | |
| Corynebacterium | glutamicum | | | B12417 | | | | | |
| Corynebacterium | glutamicum | | | B12418 | | | | | |
| Corynebacterium | glutamicum | | | B11476 | | | | | |
| Corynebacterium | glutamicum | 21608 | | | | | | | |
| Corynebacterium | lilium | | P973 | | | | | | |
| Corynebacterium | nitrilophilus | 21419 | | | | 11594 | | | |
| Corynebacterium | spec. | | P4445 | | | | | | |
| Corynebacterium | spec. | | P4446 | | | | | | |
| Corynebacterium | spec. | 31088 | | | | | | | |
| Corynebacterium | spec. | 31089 | | | | | | | |
| Corynebacterium | spec. | 31090 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | spec. | 31090 | | | | | | | |
| Corynebacterium | spec. | 31090 | | | | | | | |
| Corynebacterium | spec. | 15954 | | | | | | | 20145 |
| Corynebacterium | spec. | 21857 | | | | | | | |
| Corynebacterium | spec. | 21862 | | | | | | | |
| Corynebacterium | spec. | 21863 | | | | | | | |

ATCC: American Type Culture Collection, Rockville, MD, USA
FERM: Fermentation Research Institute, Chiba, Japan
NRRL: ARS Culture Collection, Northern Regional Research Laboratory, Peoria, IL, USA
CECT: Coleccion Espanola de Cultivos Tipo, Valencia, Spain
NCIMB: National Collection of Industrial and Marine Bacteria Ltd., Aberdeen, UK
CBS: Centraalbureau voor Schimmelcultures, Baarn, NL
NCTC: National Collection of Type Cultures, London, UK
DSMZ: Deutsche Sammlung von Mikroorganismen und Zellkulturen, Braunschweig, Germany
For reference see Sugawara, H. et al. (1993) World directory of collections of cultures of microorganisms: Bacteria, fungi and yeasts (4$^{th}$ edn), World federation for culture collections world data center on microorganisms, Saimata, Japen.

TABLE 4

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00023 | 3579 | GB_EST33:AI776129 | 483 | AI776129 | EST257217 tomato resistant, Cornell *Lycopersicon esculentum* cDNA clone cLER17D3, mRNA sequence. | *Lycopersicon esculentum* | 40.956 | 29 Jun. 1999 |
| | | GB_EST33:AI776129 | 483 | AI776129 | EST257217 tomato resistant, Cornell *Lycopersicon esculentum* cDNA clone cLER17D3, mRNA sequence. | *Lycopersicon esculentum* | 40.956 | 29 Jun. 1999 |
| rxa00044 | 1059 | EM_PAT:E11760 | 6911 | E11760 | Base sequence of sucrase gene. | *Corynebacterium glutamicum* | 42.979 | 08 Oct. 1997 (Rel. 52, Created) |
| | | GB_PAT:I26124 | 6911 | I26124 | Sequence 4 from U.S. Pat. No. 5556776. | Unknown. | 42.979 | 07 Oct. 1996 |
| | | GB_BA2:ECOUW89 | 176195 | U00006 | *E. coli* chromosomal region from 89.2 to 92.8 minutes. | *Escherichia coli* | 39.097 | 17 Dec. 1993 |
| | | GB_PAT:E16763 | 2517 | E16763 | gDNA encoding aspartate transferase (AAT). | *Corynebacterium glutamicum* | 95.429 | 28 Jul. 1999 |
| rxa00064 | 1401 | GB_HTG2:AC007892 | 134257 | AC007892 | *Drosophila melanogaster* chromosome 3 clone BACR02O3 (D797) RPCI-98 02.O.3 map 99B-99B strain y; cn bw sp, *SEQUENCING IN PROGRESS*, 113 unordered pieces. | *Drosophila melanogaster* | 31.111 | 2 Aug. 1999 |
| | | GB_HTG2:AC007892 | 134257 | AC007892 | *Drosophila melanogaster* chromosome 3 clone BACR02O3 (D797) RPCI-98 02.O.3 map 99B-99B strain y; cn bw sp, *SEQUENCING IN PROGRESS*, 113 unordered pieces. | *Drosophila melanogaster* | 31.111 | 2 Aug. 1999 |
| rxa00072 | | | | | | | | |
| rxa00105 | 798 | GB_BA1:MTV002 | 56414 | AL008967 | *Mycobacterium tuberculosis* H37Rv complete genome; segment 122/162. | *Mycobacterium tuberculosis* | 37.753 | 17 Jun. 1998 |
| | | GB_BA1:ECU29581 | 71128 | U29581 | *Escherichia coli* K-12 genome; approximately 63 to 64 minutes. | *Escherichia coli* | 35.669 | 14 Jan. 1997 |
| | | GB_BA2:AE000366 | 10405 | AE000366 | *Escherichia coli* K-12 MG1655 section 256 of 400 of the complete genome. | *Escherichia coli* | 35.669 | 12 Nov. 1998 |
| rxa00106 | 579 | GB_EST15:AA494237 | 367 | AA494237 | ng83f04.s1 NCI_CGAP_Pr6 *Homo sapiens* cDNA clone IMAGE: 941407 similar to SW: DYR_LACCA P00381 DIHYDROFOLATE REDUCTASE;, mRNA sequence. | *Homo sapiens* | 42.896 | 20 Aug. 1997 |
| | | GB_BA2:AF161327 | 2021 | AF161327 | *Corynebacterium diphtheriae* histidine kinase ChrS (chrS) and response regulator ChrA (chrA) genes, complete cds. | *Corynebacterium diphtheriae* | 40.210 | 9 Sep. 1999 |
| | | GB_PAT:AR041189 | 654 | AR041189 | Sequence 4 from U.S. Pat. No. 5811286. | Unknown. | 41.176 | 29 Sep. 1999 |
| rxa00115 | 1170 | GB_PR4:AC007110 | 148336 | AC007110 | *Homo sapiens* chromosome 17, clone hRPK.472_J_18, complete sequence. | *Homo sapiens* | 36.783 | 30 Mar. 1999 |
| | | GB_HTG3:AC008537 | 170030 | AC008537 | *Homo sapiens* chromosome 19 clone CIT-HSPC_490E21, *SEQUENCING IN PROGRESS*, 93 unordered pieces. | *Homo sapiens* | 40.296 | 2 Sep. 1999 |
| | | GB_HTG3:AC008537 | 170030 | AC008537 | *Homo sapiens* chromosome 19 clone CIT-HSPC_490E21, *SEQUENCING IN PROGRESS*, 93 unordered pieces. | *Homo sapiens* | 40.296 | 2 Sep. 1999 |
| rxa00116 | 1284 | GB_BA2:AF062345 | 16458 | AF062345 | *Caulobacter crescentus* Sst1 (sst1), S-layer protein subunit (rsaA), ABC transporter (rsaD), membrane forming unit (rsaE), putative GDP-mannose-4,6-dehydratase (lpsC), putative acetyltransferase (lpsB), putative perosamine synthetase (lpsE), putative mannosyltransferase (lpsD), putative mannosyltransferase (lpsE), outer membrane protein (rsaF), and putative perosamine transferase (lpsE) genes, complete cds. | *Caulobacter crescentus* | 36.235 | 19 Oct. 1999 |
| | | GB_PAT:I18647 | 3300 | I18647 | Sequence 6 from U.S. Pat. No. 5500353. | Unknown. | 36.821 | 07 Oct. 1996 |
| | | GB_GSS13:AQ446197 | 751 | AQ446197 | nbxb0062D16r CUGI Rice BAC Library *Oryza sativa* genomic clone nbxb0062D16r; genomic survey sequence. | *Oryza sativa* | 38.124 | 8 Apr. 1999 |
| rxa00131 | 732 | GB_BA1:MTY20B11 | 36330 | Z95121 | *Mycobacterium tuberculosis* H37Rv complete genome; segment 139/162. | *Mycobacterium tuberculosis* | 43.571 | 17 Jun. 1998 |
| | | GB_BA1:SAR7932 | 15176 | AJ007932 | *Streptomyces argillaceus* mithramycin biosynthetic genes. | *Streptomyces argillaceus* | 41.116 | 15 Jun. 1999 |
| | | GB_BA1:MTY20B11 | 36330 | Z95121 | *Mycobacterium tuberculosis* H37Rv complete genome; segment 139/162. | *Mycobacterium tuberculosis* | 39.726 | 17 Jun. 1998 |
| rxa00132 | 1557 | GB_BA1:MTY20B11 | 36330 | Z95121 | *Mycobacterium tuberculosis* H37Rv complete genome; segment 139/162. | *Mycobacterium tuberculosis* | 36.788 | 17 Jun. 1998 |

TABLE 4-continued
ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_IN2:TVU40872 | 1882 | U40872 | Trichomonas vaginalis S-adenosyl-L-homocysteine hydrolase gene, complete cds. | Trichomonas vaginalis | 61,914 | 31 Oct. 1996 |
| | | GB_HTG6:AC010706 | 169265 | AC010706 | Drosophila melanogaster chromosome X clone BACR36D15 (D887) RPCI-98 36.D.15 map 13C-13E strain y; cn bw sp. *SEQUENCING IN PROGRESS*, 74 unordered pieces. | Drosophila melanogaster | 51,325 | 22 Nov. 1999 |
| rxa0145 | 1059 | GB_BA1:MTCY2B12 | 20431 | Z81011 | Mycobacterium tuberculosis H37Rv complete genome; segment 61/162. | Mycobacterium tuberculosis | 63,365 | 18 Jun. 1998 |
| | | GB_BA1:PSEPYRBX | 2273 | L19649 | Pseudomonas aeruginosa aspartate transcarbamoylase (pyrB) and dihydroorotase-like (pyrX) genes, complete cds's. | Pseudomonas aeruginosa | 56,080 | 26 Jul. 1993 |
| | | GB_BA1:LLPYRBDNA | 1468 | X84262 | L. leichmannii pyrB gene. | Lactobacillus leichmannii | 47,514 | 29 Apr. 1997 |
| rxa0146 | 1464 | GB_BA1:MTCY2B12 | 20431 | Z81011 | Mycobacterium tuberculosis H37Rv complete genome; segment 61/162. | Mycobacterium tuberculosis | 60,714 | 18 Jun. 1998 |
| | | GB_BA1:MTCY154 | 13935 | Z98209 | Mycobacterium tuberculosis H37Rv complete genome; segment 121/162. | Mycobacterium tuberculosis | 39,229 | 17 Jun. 1998 |
| | | GB_BA1:MSGY154 | 40221 | AD000002 | Mycobacterium tuberculosis sequence from clone y154. | Mycobacterium tuberculosis | 36,618 | 03 Dec. 1996 |
| rxa0147 | 1302 | GB_BA1:MTCY2B12 | 20431 | Z81011 | Mycobacterium tuberculosis H37Rv complete genome; segment 61/162. | Mycobacterium tuberculosis | 61,527 | 18 Jun. 1998 |
| | | GB_BA1:MSGB937CS | 38914 | L78820 | Mycobacterium leprae cosmid B937 DNA sequence. | Mycobacterium leprae | 59,538 | 15 Jun. 1996 |
| | | GB_BA1:PAU81259 | 7285 | U81259 | Pseudomonas aeruginosa dihydrodipicolinate reductase (dapB) gene, partial cds, carbamoylphosphate synthetase large subunit (carB) genes, complete cds, carbamoylphosphate synthetase small subunit (carA) and | Pseudomonas aeruginosa | 55,396 | 23 Dec. 1996 |
| rxa0156 | 1233 | GB_BA1:SC9B10 | 33320 | AL009204 | Streptomyces coelicolor cosmid 9B10. | Streptomyces coelicolor | 52,666 | 10 Feb. 1999 |
| | | GB_BA2:AF002133 | 15437 | AF002133 | Mycobacterium avium strain GIR10 transcriptional regulator (mav81) gene, partial cds, aconitase (acn), invasin 1 (inv1), invasin 2 (inv2), transcriptional regulator (moxR), ketoacyl-reductase (fabG), enoyl-reductase (inhA) and ferrochelatase (mav272) genes, complete cds. | Mycobacterium avium | 54,191 | 26 Mar. 1998 |
| | | GB_BA1:D85417 | 7984 | D85417 | Propionibacterium freudenreichii hemY, hemH, hemB, hemX, hemR and hemL genes, complete cds. | Propionibacterium freudenreichii | 46,667 | 6 Feb. 1999 |
| rxa0166 | 783 | GB_HTG3:AC008167 | 174223 | AC008167 | Homo sapiens clone NH0172O13, *SEQUENCING IN PROGRESS*, 7 unordered pieces. | Homo sapiens | 37,451 | 21 Aug. 1999 |
| | | GB_HTG3:AC008167 | 174223 | AC008167 | Homo sapiens clone NH0172O13, *SEQUENCING IN PROGRESS*, 7 unordered pieces. | Homo sapiens | 37,451 | 21 Aug. 1999 |
| | | GB_HTG4:AC010118 | 80605 | AC010118 | Drosophila melanogaster chromosome 3L/62B1 clone RPCI98-10D15, *** SEQUENCING IN PROGRESS***, 51 unordered pieces. | Drosophila melanogaster | 38,627 | 16 Oct. 1999 |
| rxa0198 | 672 | GB_BA1:AB024708 | 8734 | AB024708 | Corynebacterium glutamicum gltB and gltD genes for glutamine 2-oxoglutarate aminotransferase large and small subunits, complete cds. | Corynebacterium glutamicum | 92,113 | 13 Mar. 1999 |
| | | GB_BA1:AB024708 | 8734 | AB024708 | Corynebacterium glutamicum gltB and gltD genes for glutamine 2-oxoglutarate aminotransferase large and small subunits, complete cds. | Corynebacterium glutamicum | 93,702 | 13 Mar. 1999 |
| | | GB_EST24:AI232702 | 528 | AI232702 | EST229390 Normalized rat kidney, Bento Soares Rattus sp. cDNA clone RKICF35 3' end, mRNA sequence. | Rattus sp. | 34,221 | 31 Jan. 1999 |
| rxa0216 | 1113 | GB_HTG2:HSDJ850E9 | 117353 | AL121758 | Homo sapiens chromosome 20 clone RP5-850E9, *SEQUENCING IN PROGRESS*, in unordered pieces. | Homo sapiens | 37,965 | 03 Dec. 1999 |
| | | GB_HTG2:HSDJ850E9 | 117353 | AL121758 | Homo sapiens chromosome 20 clone RP5-850E9, *SEQUENCING IN PROGRESS*, in unordered pieces. | Homo sapiens | 37,965 | 03 Dec. 1999 |
| | | GB_PR2:CNS01DSA | 159400 | AL121766 | Human chromosome 14 DNA sequence *IN PROGRESS* BAC R-412H8 of RPCI-11 library from chromosome 14 of Homo sapiens (Human), complete sequence. | Homo sapiens | 38,796 | 11 Nov. 1999 |
| rxa0219 | 1065 | GB_HTG2:AC005079_0 | 110000 | AC005079 | Homo sapiens clone RG252P22, *SEQUENCING IN PROGRESS*, 3 | Homo sapiens | 38,227 | 22 Nov. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG2:AC005079_1 | 110000 | AC005079 | unordered pieces. *Homo sapiens* clone RG252P22, *SEQUENCING IN PROGRESS*, 3 unordered pieces. | *Homo sapiens* | 38,227 | 22 Nov. 1998 |
| | | GB_HTG2:AC005079_1 | 110000 | AC005079 | *Homo sapiens* clone RG252P22, *SEQUENCING IN PROGRESS*, 3 unordered pieces. | *Homo sapiens* | 38,227 | 22 Nov. 1998 |
| rxa00223 | 1212 | GB_BA1:PPEA3NIF | 19771 | X99694 | Plasmid pEA3 nitrogen fixation genes. | *Enterobacter agglomerans* | 48,826 | 2 Aug. 1996 |
| | | GB_BA2:AF128444 | 2477 | AF128444 | *Rhodobacter capsulatus* molybdenum cofactor biosynthetic gene cluster, partial sequence. | *Rhodobacter capsulatus* | 40,135 | 22 Mar. 1999 |
| | | GB_HTG4:AC010111 | 138938 | AC010111 | *Drosophila melanogaster* chromosome 3L/70C1 clone RPCI98-9B18, *SEQUENCING IN PROGRESS*, 64 unordered pieces. | *Drosophila melanogaster* | 39,527 | 16 Oct. 1999 |
| rxa00229 | 803 | GB_BA2:AF124518 | 1758 | AF124518 | *Corynebacterium glutamicum* 3-dehydroquinase (aroD) and shikimate dehydrogenase (aroE) genes, complete cds. | *Corynebacterium glutamicum* | 98,237 | 18 May 1999 |
| | | GB_PR3:AC004593 | 150221 | AC004593 | *Homo sapiens* PAC clone DJ0964C11 from 7p14-p15, complete sequence. | *Homo sapiens* | 36,616 | 18 Apr. 1998 |
| | | GB_HTG2:AC006907 | 188972 | AC006907 | *Caenorhabditis elegans* clone Y76B12, *SEQUENCING IN PROGRESS*, 25 unordered pieces. | *Caenorhabditis elegans* | 37,095 | 26 Feb. 1999 |
| rxa00241 | 1626 | GB_BA1:CGLYSI | 4232 | X60312 | *C. glutamicum* lysI gene for L-lysine permease. | *Corynebacterium glutamicum* | 100,000 | 30 Jan. 1992 |
| | | GB_HTG1:PFMAL13P1 | 192581 | AL049180 | *Plasmodium falciparum* chromosome 13 strain 3D7, *SEQUENCING IN PROGRESS*, in unordered pieces. | *Plasmodium falciparum* | 34,947 | 11 Aug. 1999 |
| | | GB_HTG1:PFMAL13P1 | 192581 | AL049180 | *Plasmodium falciparum* chromosome 13 strain 3D7, *SEQUENCING IN PROGRESS*, in unordered pieces. | *Plasmodium falciparum* | 34,947 | 11 Aug. 1999 |
| rxa00262 | 1197 | GB_IN2:EHU89655 | 3219 | U89655 | *Entamoeba histolytica* unconventional myosin IB mRNA, complete cds. | *Entamoeba histolytica* | 36,496 | 23 May 1997 |
| | | GB_IN2:EHU89655 | 3219 | U89655 | *Entamoeba histolytica* unconventional myosin IB mRNA, complete cds. | *Entamoeba histolytica* | 37,544 | 23 May 1997 |
| rxa00266 | 531 | GB_RO:AF016190 | 2939 | AF016190 | *Mus musculus* connexin-36 (Cx36) gene, complete cds. | *Mus musculus* | 41,856 | 9 Feb. 1999 |
| | | EM_PAT:E09719 | 3505 | E09719 | DNA encoding precursor protein of alkaline cellulase. | *Bacillus* sp. | 34,741 | 08 Oct. 1997 (Rel. 52, Created) |
| | | GB_PAT:E02133 | 3494 | E02133 | gDNA encoding alkaline cellulase. | *Bacillus* sp. | 34,741 | 29 Sep. 1997 |
| rxa00278 | 1155 | GB_IN1:CELK05F6 | 36912 | AF040653 | *Caenorhabditis elegans* cosmid K05F6. | *Caenorhabditis elegans* | 36,943 | 6 Jan. 1998 |
| | | GB_BA1:CGU43535 | 2531 | U43535 | *Corynebacterium glutamicum* multidrug resistance protein (cmr) gene, complete cds. | *Corynebacterium glutamicum* | 36,658 | 9 Apr. 1997 |
| | | GB_RO:RNU30789 | 3510 | U30789 | *Rattus norvegicus* clone N27 mRNA. | *Rattus norvegicus* | 38,190 | 20 Aug. 1996 |
| rxa00295 | 1125 | GB_BA2:CGU31281 | 1614 | U31281 | *Corynebacterium glutamicum* biotin synthase (bioB) gene, complete cds. | *Corynebacterium glutamicum* | 99,111 | 21 Nov. 1996 |
| | | GB_BA1:BRLBIOBA | 1647 | D14084 | *Brevibacterium flavum* gene for biotin synthetase, complete cds. | *Brevibacterium flavum* | 98,489 | 3 Feb. 1999 |
| | | GB_PAT:E03937 | 1005 | E03937 | DNA sequence encoding *Brevibacterium flavum* biotin-synthase. | *Corynebacterium glutamicum* | 98,207 | 29 Sep. 1997 |
| rxa00323 | 1461 | GB_BA1:MTCY427 | 38110 | Z70692 | *Mycobacterium tuberculosis* H37Rv complete genome; segment 99/162. | *Mycobacterium tuberculosis* | 35,615 | 24 Jun. 1999 |
| | | GB_BA1:MSGB32CS | 36404 | L78818 | *Mycobacterium leprae* cosmid B32 DNA sequence. | *Mycobacterium leprae* | 60,917 | 15 Jun. 1996 |
| | | GB_BA1:MTCY427 | 38110 | Z70692 | *Mycobacterium tuberculosis* H37Rv complete genome; segment 99/162. | *Mycobacterium tuberculosis* | 44,606 | 24 Jun. 1999 |
| rxa00324 | 3258 | GB_BA1:MSGB32CS | 36404 | L78818 | *Mycobacterium leprae* cosmid B32 DNA sequence. | *Mycobacterium leprae* | 52,516 | 15 Jun. 1996 |
| | | GB_BA1:MTCY427 | 38110 | Z70692 | *Mycobacterium tuberculosis* H37Rv complete genome; segment 99/162. | *Mycobacterium tuberculosis* | 38,079 | 24 Jun. 1999 |
| | | GB_OM:BOVELA | 3242 | J02717 | Bovine elastin a mRNA, complete cds. | *Bos taurus* | 39,351 | 27 Apr. 1993 |
| rxa00330 | 1566 | GB_BA1:CGTHRC | 3120 | X56037 | *Corynebacterium glutamicum* thrC gene for threonine synthase (EC 4.2.99.2). Sequence 4 from Patent WO 8809819. | *Corynebacterium glutamicum* | 99,808 | 17 Jun. 1997 |
| | | GB_PAT:I09078 | 3146 | I09078 | | Unknown. | 99,617 | 02 Dec. 1994 |
| | | GB_BA1:BLTHRESYN | 1892 | Z29563 | *Brevibacterium lactofermentum*; ATCC 13869;; DNA (genomic);. | *Corynebacterium glutamicum* | 99,170 | 20 Sep. 1995 |
| rxa00335 | 1554 | GB_BA1:CGGLNA | 3686 | Y13221 | *Corynebacterium glutamicum* glnA gene. | *Corynebacterium glutamicum* | 100,000 | 28 Aug. 1997 |
| | | GB_BA2:AF005635 | 1690 | AF005635 | *Corynebacterium glutamicum* glutamine synthetase (glnA) gene, complete cds. | *Corynebacterium glutamicum* | 98,906 | 14 Jun. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00347 | 891 | GB_BA1:MSGB27CS | 38793 | L78817 | *Mycobacterium leprae* cosmid B27 DNA sequence. | *Mycobacterium leprae* | 66,345 | 15 Jun. 1996 |
| | | GB_EST27:AI455217 | 624 | AI455217 | LD21828.3prime LD *Drosophila melanogaster* embryo pOT2 *Drosophila melanogaster* cDNA clone LD21828 3prime, mRNA sequence. | *Drosophila melanogaster* | 34,510 | 09 Mar. 1999 |
| | | GB_BA2:SSU30252 | 2891 | U30252 | *Synechococcus* PCC7942 nucleoside diphosphate kinase and ORF2 protein genes, complete cds, ORF1 protein gene, partial cds, and neutral site I for vector use. | *Synechococcus* PCC7942 | 37,084 | 29 Oct. 1999 |
| | | GB_EST21:AA911262 | 581 | AA911262 | oe75a02.s1 NCI_CGAP_Lu5 *Homo sapiens* cDNA clone IMAGE: 1417418 3' similar to gb: A18757 UROKINASE PLASMINOGEN ACTIVATOR SURFACE RECEPTOR, GPI-ANCHORED (HUMAN); mRNA sequence. | *Homo sapiens* | 37,500 | 21 Apr. 1998 |
| rxa00351 | 1578 | GB_BA1:MLU15187 | 36138 | U15187 | *Mycobacterium leprae* cosmid L296. | *Mycobacterium leprae* | 52,972 | 09 Mar. 1995 |
| | | GB_IN2:AC004373 | 72722 | AC004373 | *Drosophila melanogaster* DNA sequence (P1 DS05273 (D80)), complete sequence. | *Drosophila melanogaster* | 46,341 | 17 Jul. 1998 |
| | | GB_IN2:AF145653 | 3197 | AF145653 | *Drosophila melanogaster* clone GH08860 BcDNA.GH08860 (BcDNA.GH08860) mRNA, complete cds. | *Drosophila melanogaster* | 49,471 | 14 Jun. 1999 |
| rxa00365 | 727 | GB_BA1:AB024708 | 8734 | AB024708 | *Corynebacterium glutamicum* gltB and gltD genes for glutamine 2-oxoglutarate aminotransferase large and small subunits, complete cds. | *Corynebacterium glutamicum* | 96,556 | 13 Mar. 1999 |
| | | GB_BA1:MTCY1A6 | 37751 | Z83864 | *Mycobacterium tuberculosis* H37Rv complete genome; segment 159/162. | *Mycobacterium tuberculosis* | 39,496 | 17 Jun. 1998 |
| | | GB_BA1:SC3A3 | 15901 | AL109849 | *Streptomyces coelicolor* cosmid 3A3. | *Streptomyces coelicolor* A3(2) | 37,946 | 16 Aug. 1999 |
| rxa00366 | 480 | GB_BA1:AB024708 | 8734 | AB024708 | *Corynebacterium glutamicum* gltB and gltD genes for glutamine 2-oxoglutarate aminotransferase large and small subunits, complete cds. | *Corynebacterium glutamicum* | 99,374 | 13 Mar. 1999 |
| | | GB_BA1:MTCY1A6 | 37751 | Z83864 | *Mycobacterium tuberculosis* H37Rv complete genome; segment 159/162. | *Mycobacterium tuberculosis* | 41,333 | 17 Jun. 1998 |
| | | GB_BA1:SC3A3 | 15901 | AL109849 | *Streptomyces coelicolor* cosmid 3A3. | *Streptomyces coelicolor* A3(2) | 37,554 | 16 Aug. 1999 |
| rxa00367 | 4653 | GB_BA1:AB024708 | 8734 | AB024708 | *Corynebacterium glutamicum* gltB and gltD genes for glutamine 2-oxoglutarate aminotransferase large and small subunits, complete cds. | *Corynebacterium glutamicum* | 99,312 | 13 Mar. 1999 |
| | | GB_BA1:MTCY1A6 | 37751 | Z83864 | *Mycobacterium tuberculosis* H37Rv complete genome; segment 159/162. | *Mycobacterium tuberculosis* | 36,971 | 17 Jun. 1998 |
| | | GB_BA1:SC3A3 | 15901 | AL109849 | *Streptomyces coelicolor* cosmid 3A3. | *Streptomyces coelicolor* A3(2) | 37,905 | 16 Aug. 1999 |
| rxa00371 | 1917 | GB_VI:SBVORFS | 7568 | M89923 | Sugarcane bacilliform virus ORF 1, 2, and 3 DNA, complete cds. | Sugarcane bacilliform virus | 35,843 | 12 Jun. 1993 |
| | | GB_EST37:AI967505 | 380 | AI967505 | Ljirnpest03-215-c10 Ljirnp Lambda HybriZap two-hybrid library *Lotus japonicus* cDNA clone LP215-03-c10 5' similar to 60S ribosomal protein L39, mRNA sequence. | *Lotus japonicus* | 42,593 | 24 Aug. 1999 |
| rxa00377 | 1245 | GB_IN1:CELK09H9 | 37881 | AF043700 | *Caenorhabditis elegans* cosmid K09H9. | *Caenorhabditis elegans* | 34,295 | 22 Jan. 1998 |
| | | GB_BA1:CCU13664 | 1678 | U13664 | *Caulobacter crescentus* uroporphyrinogen decarboxylase homolog (hemE) gene, partial cds. | *Caulobacter crescentus* | 36,832 | 24 Mar. 1995 |
| | | GB_PL1:ANSDGENE | 1299 | Y08866 | *A. nidulans* sD gene. | *Emericella nidulans* | 39,603 | 17 Oct. 1996 |
| | | GB_GSS4:AQ730303 | 483 | AQ730303 | HS_5505_B1_C04_I7A RPCI-11 Human Male BAC Library *Homo sapiens* genomic clone Plate = 1081 Col = 7 Row = F, genomic survey sequence. | *Homo sapiens* | 36,728 | 15 Jul. 1999 |
| rxa00382 | 1425 | GB_BA1:PAHEML | 4444 | X82072 | *P. aeruginosa* hemL gene. | *Pseudomonas aeruginosa* | 54,175 | 18 Dec. 1995 |
| | | GB_BA1:MTY25D10 | 40838 | Z95558 | *Mycobacterium tuberculosis* H37Rv complete genome; segment 28/162. | *Mycobacterium tuberculosis* | 61,143 | 17 Jun. 1998 |
| | | GB_BA1:MSGY224 | 40051 | AD000004 | *Mycobacterium tuberculosis* sequence from clone y224. | *Mycobacterium tuberculosis* | 61,143 | 03 Dec. 1996 |
| rxa00383 | 1467 | GB_BA1:MLCB1222 | 34714 | AL049491 | *Mycobacterium leprae* cosmid B1222. | *Mycobacterium leprae* | 43,981 | 27 Aug. 1999 |
| | | GB_HTG2:AC006269 | 167171 | AC006269 | *Homo sapiens* chromosome 17 clone hRPK.515_E_23 map 17, *** SEQUENCING IN PROGRESS***, 2 ordered pieces. | *Homo sapiens* | 35,444 | 10 Jun. 1999 |
| | | GB_HTG2:AC007638 | 178053 | AC007638 | *Homo sapiens* chromosome 17 clone hRPK.515_O_17 map 17, *** SEQUENCING IN PROGRESS***, 8 unordered pieces. | *Homo sapiens* | 34,821 | 22 May 1999 |
| rxa00391 | 843 | GB_EST38:AW017053 | 613 | AW017053 | EST272398 *Schistosoma mansoni* male, Phil LoVerde/Joe Merrick | *Schistosoma mansoni* | 40,472 | 10 Sep. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_PAT:AR065852 | 32207 | AR065852 | *Schistosoma mansoni* cDNA clone SMMAS14 5' end, mRNA sequence. Sequence 20 from U.S. Pat. No. 5849564. | Unknown. | 38,586 | 29 Sep. 1999 |
| | | GB_VI:AF148805 | 28559 | AF148805 | Kaposi's sarcoma-associated herpesvirus ORF 68 gene, partial cds; and ORF 69, kaposin, v-FLIP, v-cyclin, latent nuclear antigen, ORF K14, v-GPCR, putative phosphoribosylformylglycinamidine synthase, and LAMP (LAMP) genes, complete cds. | Kaposi's sarcoma-associated herpesvirus | 38,509 | 2 Aug. 1999 |
| rxa00393 | 1017 | GB_BA1:MTY25D10 | 40838 | Z95558 | *Mycobacterium tuberculosis* H37Rv complete genome; segment 28/162. | *Mycobacterium tuberculosis* | 36,308 | 17 Jun. 1998 |
| | | GB_BA1:MSGY224 | 40051 | AD000004 | *Mycobacterium tuberculosis* sequence from clone y224. | *Mycobacterium tuberculosis* | 39,282 | 03 Dec. 1996 |
| | | GB_BA1:MLB1306 | 7762 | Y13803 | *Mycobacterium leprae* cosmid B1306 DNA. | *Mycobacterium leprae* | 39,228 | 24 Jun. 1997 |
| rxa00402 | 623 | GB_BA2:AF052652 | 2096 | AF052652 | *Corynebacterium glutamicum* homoserine O-acetyltransferase (metA) gene, complete cds. | *Corynebacterium glutamicum* | 99,672 | 19 Mar. 1998 |
| | | GB_BA2:AF109162 | 4514 | AF109162 | *Corynebacterium diphtheriae* heme uptake locus, complete sequence. | *Corynebacterium diphtheriae* | 40,830 | 8 Jun. 1999 |
| | | GB_BA2:AF092918 | 20758 | AF092918 | *Pseudomonas alcaligenes* outer membrane Xcp-secretion system gene cluster. | *Pseudomonas alcaligenes* | 50,161 | 06 Dec. 1998 |
| rxa00403 | 1254 | GB_BA2:AF052652 | 2096 | AF052652 | *Corynebacterium glutamicum* homoserine O-acetyltransferase (metA) gene, complete cds. | *Corynebacterium glutamicum* | 99,920 | 19 Mar. 1998 |
| rxa00405 | 613 | GB_BA1:MTV016 | 53662 | AL021841 | *Mycobacterium tuberculosis* H37Rv complete genome; segment 143/162. | *Mycobacterium tuberculosis* | 52,898 | 23 Jun. 1999 |
| | | GB_EST23:AI111288 | 750 | AI111288 | SWOvAMCAQ02A05SK *Onchocerca volvulus* adult male cDNA (SAW98MIWOvAM) *Onchocerca volvulus* cDNA clone SWOvAMCAQ02A05 5', mRNA sequence. | *Onchocerca volvulus* | 37,565 | 31 Aug. 1998 |
| | | GB_BA1:MTV016 | 53662 | AL021841 | *Mycobacterium tuberculosis* H37Rv complete genome; segment 143/162. | *Mycobacterium tuberculosis* | 57,259 | 23 Jun. 1999 |
| | | GB_PR4:AC005145 | 143678 | AC005145 | *Homo sapiens* Xp22-166-169 GSHB-523A23 (Genome Systems Human BAC library) complete sequence. | *Homo sapiens* | 34,179 | 08 Dec. 1998 |
| rxa00420 | 1587 | GB_BA1:MTV016 | 53662 | AL021841 | *Mycobacterium tuberculosis* H37Rv complete genome; segment 143/162. | *Mycobacterium tuberculosis* | 40,169 | 23 Jun. 1999 |
| | | GB_BA1:MTY13D12 | 37085 | Z80343 | *Mycobacterium tuberculosis* H37Rv complete genome; segment 143/162. | *Mycobacterium tuberculosis* | 62,031 | 17 Jun. 1998 |
| | | GB_BA1:MSGY126 | 37164 | AD000012 | *Mycobacterium tuberculosis* sequence from clone y126. | *Mycobacterium tuberculosis* | 61,902 | 10 Dec. 1996 |
| | | GB_BA1:MSGB971CS | 37566 | L78821 | *Mycobacterium leprae* cosmid B971 DNA sequence. | *Mycobacterium leprae* | 39,651 | 15 Jun. 1996 |
| rxa00435 | 1296 | GB_BA1:AFACBBTZ | 2760 | M68904 | *Alcaligenes eutrophus* chromosomal transketolase (cbbTc) and phosphoglycolate phosphatase (cbbZc) genes, complete cds. | *Ralstonia eutropha* | 38,677 | 27 Jul. 1994 |
| | | GB_HTG4:AC009541 | 169583 | AC009541 | *Homo sapiens* chromosome 7, *SEQUENCING IN PROGRESS*, 25 unordered pieces. | *Homo sapiens* | 36,335 | 12 Oct. 1999 |
| | | GB_HTG4:AC009541 | 169583 | AC009541 | *Homo sapiens* chromosome 7, *SEQUENCING IN PROGRESS*, 25 unordered pieces. | *Homo sapiens* | 36,335 | 12 Oct. 1999 |
| rxa00437 | 579 | GB_PR4:AC005951 | 155450 | AC005951 | *Homo sapiens* chromosome 17, clone hRPK.372_K_20, complete sequence. | *Homo sapiens* | 31,738 | 18 Nov. 1998 |
| | | GB_BA1:SC2A11 | 22789 | AL031184 | *Streptomyces coelicolor* cosmid 2A11. | *Streptomyces coelicolor* | 43,262 | 5 Aug. 1998 |
| | | GB_PR4:AC005951 | 155450 | AC005951 | *Homo sapiens* chromosome 17, clone hRPK.372_K_20, complete sequence. | *Homo sapiens* | 37,647 | 18 Nov. 1998 |
| rxa00439 | 591 | GB_BA1:MTV016 | 53662 | AL021841 | *Mycobacterium tuberculosis* H37Rv complete genome; segment 143/162. | *Mycobacterium tuberculosis* | 37,088 | 23 Jun. 1999 |
| | | GB_PL2:AF167358 | 1022 | AF167358 | *Rumex acetosa* expansin (EXP3) gene, partial cds. | *Rumex acetosa* | 46,538 | 17 Aug. 1999 |
| | | GB_HTG3:AC009120 | 269445 | AC009120 | *Homo sapiens* chromosome 16 clone RPCI-11_484E3, *SEQUENCING IN PROGRESS*, 34 unordered pieces. | *Homo sapiens* | 43,276 | 3 Aug. 1999 |
| rxa00440 | 582 | GB_BA2:SKZ86111 | 7860 | Z86111 | *Streptomyces lividans* rpsP, trmD, rplS, sipW, sipX, sipY, sipZ, mutT genes and 4 open reading frames. | *Streptomyces lividans* | 43,080 | 27 Oct. 1999 |
| | | GB_BA1:SC2E1 | 38962 | AL023797 | *Streptomyces coelicolor* cosmid 2E1. | *Streptomyces coelicolor* | 42,931 | 4 Jun. 1998 |
| | | GB_BA1:SC2E1 | 38962 | AL023797 | *Streptomyces coelicolor* cosmid 2E1. | *Streptomyces coelicolor* | 36,702 | 4 Jun. 1998 |
| rxa00441 | 1287 | GB_PR2:HS173D1 | 117338 | AL031984 | Human DNA sequence from clone 173D1 on chromosome 1p36.21-36.33. | *Homo sapiens* | 38,027 | 23 Nov. 1999 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
| rxa00446 | | GB_HTG2:HSDJ719K3 | 267114 AL109931 | Contains ESTs, STSs and GSSs, complete sequence. | Homo sapiens | 34,521 | 03 Dec. 1999 |
| | | GB_HTG2:HSDJ719K3 | 267114 AL109931 | Homo sapiens chromosome X clone RP4-719K3 map q21.1-21.31, **SEQUENCING IN PROGRESS**, in unordered pieces. | Homo sapiens | 34,521 | 03 Dec. 1999 |
| | | GB_HTG2:HSDJ719K3 | 267114 AL109931 | Homo sapiens chromosome X clone RP4-719K3 map q21.1-21.31, **SEQUENCING IN PROGRESS**, in unordered pieces. | Homo sapiens | 34,521 | 03 Dec. 1999 |
| rxa00448 | 987 | GB_BA1:SCD78 | 36224 AL034355 | Streptomyces coelicolor cosmid D78. | Streptomyces coelicolor | 56,410 | 26 Nov. 1998 |
| | | GB_HTG4:AC009367 | 226055 AC009367 | Drosophila melanogaster chromosome 3L/76A2 clone RPCI98-48B15, **SEQUENCING IN PROGRESS**, 44 unordered pieces. | Drosophila melanogaster | 34,959 | 16 Oct. 1999 |
| | | GB_HTG4:AC009367 | 226055 AC009367 | Drosophila melanogaster chromosome 3L/76A2 clone RPCI98-48B15, **SEQUENCING IN PROGRESS**, 44 unordered pieces. | Drosophila melanogaster | 34,959 | 16 Oct. 1999 |
| rxa00448 | 1143 | GB_PR3:AC003670 | 88945 AC003670 | Homo sapiens 12q13.1 PAC RPCI1-130F5 (Roswell Park Cancer Institute Human PAC library) complete sequence. | Homo sapiens | 35,682 | 9 Jun. 1998 |
| | | GB_HTG2:AF029367 | 148676 AF029367 | Homo sapiens chromosome 12 clone RPCI-1 130F5 map 12q13.1, **SEQUENCING IN PROGRESS**, 156 unordered pieces. | Homo sapiens | 31,373 | 18 Oct. 1997 |
| | | GB_HTG2:AF029367 | 148676 AF029367 | Homo sapiens chromosome 12 clone RPCI-1 130F5 map 12q13.1, **SEQUENCING IN PROGRESS**, 156 unordered pieces. | Homo sapiens | 31,373 | 18 Oct. 1997 |
| rxa00450 | 424 | GB_HTG2:AC007824 | 133361 AC007824 | Drosophila melanogaster chromosome 3 clone BACR02L16 (D715) RPCI-98 02.L.16 map 89E-90A strain y; cn bw sp, **SEQUENCING IN PROGRESS**, 91 unordered pieces. | Drosophila melanogaster | 40,000 | 2 Aug. 1999 |
| | | GB_HTG2:AC007824 | 133361 AC007824 | Drosophila melanogaster chromosome 3 clone BACR02L16 (D715) RPCI-98 02.L.16 map 89E-90A strain y; cn bw sp, **SEQUENCING IN PROGRESS**, 91 unordered pieces. | Drosophila melanogaster | 40,000 | 2 Aug. 1999 |
| | | GB_EST35:AI818057 | 412 AI818057 | wk14a08.x1 NCI_CGAP_Lym12 Homo sapiens cDNA clone IMAGE: 2412278 3' similar to gb: Y00764 UBIQUINOL-CYTOCHROME C REDUCTASE 11 KD PROTEIN (HUMAN); mRNA sequence. | Homo sapiens | 35,714 | 24 Aug. 1999 |
| rxa00461 | 975 | GB_BA1:MLCB1779 | 43254 Z98271 | Mycobacterium leprae cosmid B1779. | Mycobacterium leprae | 39,308 | 8 Aug. 1997 |
| | | GB_IN1:DMC86E4 | 29352 AL021086 | Drosophila melanogaster cosmid clone 86E4. | Drosophila melanogaster | 37,487 | 27 Apr. 1999 |
| | | GB_GSS15:AQ640325 | 467 AQ640325 | 927P1-2H3.TP 927P1 Trypanosoma brucei genomic clone 927P1-2H3, genomic survey sequence. | Trypanosoma brucei | 38,116 | 8 Jul. 1999 |
| rxa00465 | | | | | | | |
| rxa00487 | 1692 | GB_BA1:BAGUAA | 3866 Y10499 | B. ammoniagenes guaA gene. | Corynebacterium ammoniagenes | 74,259 | 8 Jan. 1998 |
| rxa00488 | 1641 | GB_BA2:U00015 | 42325 U00015 | Mycobacterium leprae cosmid B1620. | Mycobacterium leprae | 37,248 | 01 Mar. 1994 |
| | | GB_BA1:MTCY78 | 33818 Z77165 | Mycobacterium tuberculosis H37Rv complete genome; segment 145/162. | Mycobacterium tuberculosis | 39,725 | 17 Jun. 1998 |
| | | GB_BA1:MTCY78 | 33818 Z77165 | Mycobacterium tuberculosis H37Rv complete genome; segment 145/162. | Mycobacterium tuberculosis | 39,451 | 17 Jun. 1998 |
| | | GB_BA2:U00015 | 42325 U00015 | Mycobacterium leprae cosmid B1620. | Mycobacterium leprae | 39,178 | 01 Mar. 1994 |
| | | GB_BA1:SCAJ10601 | 4692 AJ010601 | Streptomyces coelicolor A3(2) DNA for whiD and whiK loci. | Streptomyces coelicolor | 60,835 | 17 Sep. 1998 |
| rxa00489 | 1245 | GB_BA2:U00015 | 42325 U00015 | Mycobacterium leprae cosmid B1620. | Mycobacterium leprae | 38,041 | 01 Mar. 1994 |
| | | GB_HTG2:HS225E12 | 126464 AL031772 | Homo sapiens chromosome 6 clone RP1-225E12 map q24, **SEQUENCING IN PROGRESS**, in unordered pieces. | Homo sapiens | 36,756 | 03 Dec. 1999 |
| | | GB_HTG2:HS225E12 | 126464 AL031772 | Homo sapiens chromosome 6 clone RP1-225E12 map q24, **SEQUENCING IN PROGRESS**, in unordered pieces. | Homo sapiens | 36,756 | 03 Dec. 1999 |
| rxa00533 | 1155 | GB_BA1:CGLYS | 2803 X57226 | C. glutamicum lysC-alpha, lysC-beta and asd genes for aspartokinase-alpha and -beta subunits, and aspartate beta semialdehyde dehydrogenase, respectively (EC 2.7.2.4; EC 1.2.1.11). | Corynebacterium glutamicum | 99,913 | 17 Feb. 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00534 | 1386 | GB_BA1:CGCYSCASD | 1591 | X82928 | C. glutamicum aspartate-semialdehyde dehydrogenase gene. | Corynebacterium glutamicum | 99,221 | 17 Feb. 1997 |
| | | GB_PAT:A07546 | 2112 | A07546 | Recombinant DNA fragment (PstI-XhoI). | synthetic construct | 99,391 | 30 Jul. 1993 |
| | | GB_BA1:CGLYS | 2803 | X57226 | C. glutamicum lysC-alpha, lysC-beta and asd genes for aspartokinase-alpha and -beta subunits, and aspartate beta semialdehyde dehydrogenase, respectively (EC 2.7.2.4; EC 1.2.1.11). | Corynebacterium glutamicum | 99,856 | 17 Feb. 1997 |
| | | GB_PAT:E14514 | 2957 | L16848 | Corynebacterium flavum aspartokinase (ask), and aspartate-semialdehyde dehydrogenase (asd) genes, complete cds. | Corynebacterium flavescens | 98,701 | 11 Jun. 1993 |
| rxa00536 | 1494 | GB_PAT:E14514 | 1643 | E14514 | DNA encoding Brevibacterium aspartokinase. | Corynebacterium glutamicum | 98,773 | 28 Jul. 1999 |
| | | GB_BA1:CGLEUA | 3492 | X70959 | C. glutamicum gene leuA for isopropylmalate synthase. | Corynebacterium glutamicum | 100,000 | 10 Feb. 1999 |
| | | GB_BA1:MTV025 | 121125 | AL022121 | Mycobacterium tuberculosis H37Rv complete genome; segment 155/162. | Mycobacterium tuberculosis | 68,003 | 24 Jun. 1999 |
| | | GB_BA1:MTU88526 | 2412 | U88526 | Mycobacterium tuberculosis putative alpha-isopropyl malate synthase (leuA) gene, complete cds. | Mycobacterium tuberculosis | 68,185 | 26 Feb. 1997 |
| rxa00537 | 2409 | GB_BA2:SCD25 | 41622 | AL118514 | Streptomyces coelicolor cosmid D25. | Streptomyces coelicolor A3(2) | 63,187 | 21 Sep. 1999 |
| | | GB_BA1:MTCY7H7A | 10451 | Z95618 | Mycobacterium tuberculosis H37Rv complete genome; segment 39/162. | Mycobacterium tuberculosis | 62,401 | 17 Jun. 1998 |
| | | GB_BA1:MTU34956 | 2462 | U34956 | Mycobacterium tuberculosis phosphoribosylformylglycinamidine synthase (purL) gene, complete cds. | Mycobacterium tuberculosis | 62,205 | 28 Jan. 1997 |
| rxa00541 | 792 | GB_PAT:I92052 | 2115 | I92052 | Sequence 19 from U.S. Pat. No. 5726299. | Unknown. | 98,359 | 01 Dec. 1998 |
| | | GB_BA1:MLCB5 | 38109 | Z95151 | Mycobacterium leprae cosmid B5. | Mycobacterium leprae | 62,468 | 24 Jun. 1997 |
| | | GB_BA1:MTCY369 | 36850 | Z80226 | Mycobacterium tuberculosis H37Rv complete genome; segment 36/162. | Mycobacterium tuberculosis | 60,814 | 17 Jun. 1998 |
| rxa00558 | 1470 | GB_BA1:BAPURF | 1885 | X91252 | B. ammoniagenes purF gene. | Corynebacterium ammoniagenes | 66,095 | 5 Jun. 1997 |
| | | GB_BA1:MLU15182 | 40123 | U15182 | Mycobacterium leprae cosmid B2266. | Mycobacterium leprae | 64,315 | 09 Mar. 1995 |
| | | GB_BA1:MTCY7H7A | 10451 | Z95618 | Mycobacterium tuberculosis H37Rv complete genome; segment 39/162. | Mycobacterium tuberculosis | 64,863 | 17 Jun. 1998 |
| rxa00579 | 1983 | GB_PAT:AR016483 | 2104 | AR016483 | Sequence 1 from U.S. Pat. No. 5776740. | Unknown. | 98,810 | 05 Dec. 1998 |
| | | EM_PAT:E11273 | 2104 | E11273 | DNA encoding serine hydroxymethyltransferase. | Corynebacterium glutamicum | 98,810 | 08 Oct. 1997 (Rel. 52, Created) |
| rxa00580 | 1425 | GB_PAT:E12594 | 2104 | E12594 | DNA encoding serine hydroxymethyltransferase from Brevibacterium flavum. | Corynebacterium glutamicum | 98,810 | 24 Jun. 1998 |
| | | GB_PAT:E12594 | 2104 | E12594 | DNA encoding serine hydroxymethyltransferase from Brevibacterium flavum. | Corynebacterium glutamicum | 99,368 | 24 Jun. 1998 |
| | | GB_PAT:AR016483 | 2104 | AR016483 | Sequence 1 from U.S. Pat. No. 5776740. | Unknown. | 99,368 | 05 Dec. 1998 |
| | | EM_PAT:E11273 | 2104 | E11273 | DNA encoding serine hydroxymethyl transferase. | Corynebacterium glutamicum | 99,368 | 08 Oct. 1997 (Rel. 52, Created) |
| rxa00581 | 1092 | GB_PAT:E12594 | 2104 | E12594 | DNA encoding serine hydroxymethyltransferase from Brevibacterium flavum. | Corynebacterium glutamicum | 37,071 | 24 Jun. 1998 |
| | | EM_PAT:E11273 | 2104 | E11273 | DNA encoding serine hydroxymethyl transferase. | Corynebacterium glutamicum | 37,071 | 08 Oct. 1997 (Rel. 52, Created) |
| rxa00584 | 1248 | GB_PAT:AR016483 | 2104 | AR016483 | Sequence 1 from U.S. Pat. No. 5776740. | Unknown. | 37,071 | 05 Dec. 1998 |
| | | GB_BA1:CORAHPS | 2570 | L07603 | Corynebacterium glutamicum 3-deoxy-D-arabinoheptulosonate-7-phosphate synthase gene, complete cds. | Corynebacterium glutamicum | 98,236 | 26 Apr. 1993 |
| | | GB_BA1:AOPCZA361 | 37941 | AJ223998 | Amycolatopsis orientalis cosmid PCZA361. | Amycolatopsis orientalis | 54,553 | 29 Mar. 1999 |
| | | GB_BA1:D90714 | 14358 | D90714 | Escherichia coli genomic DNA. (16.8-17.1 min). | Escherichia coli | 53,312 | 7 Feb. 1999 |
| rxa00618 | 1230 | GB_EST19:AA802737 | 280 | AA802737 | GM06236.5prime GM Drosophila melanogaster ovary BlueScript Drosophila melanogaster cDNA clone GM06236 5prime, mRNA sequence. | Drosophila melanogaster | 39,928 | 25 Nov. 1998 |
| | | GB_EST28:AI534381 | 581 | AI534381 | SD07186.5prime SD Drosophila melanogaster Schneider L2 cell culture pOT2 | Drosophila melanogaster | 41,136 | 18 Mar. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00619 | 1551 | GB_IN1:DMANILLIN | 4029 | X89858 | Drosophila melanogaster cDNA clone SD07186 5prime similar to X89858: Ani FBgn0011558 PID: g927407 SPTREMBL: Q24240, mRNA sequence. | Drosophila melanogaster | 34,398 | 8 Nov. 1995 |
| | | GB_BA1:MTCY369 | 36850 | Z80226 | D. melanogaster mRNA for anillin protein. | Mycobacterium tuberculosis | 62,776 | 17 Jun. 1998 |
| | | GB_BA1:MLCB5 | 38109 | Z95151 | Mycobacterium tuberculosis H37Rv complete genome; segment 36/162. | Mycobacterium leprae | 61,831 | 24 Jun. 1997 |
| | | GB_PAT:A60305 | 1845 | A60305 | Mycobacterium leprae cosmid B5. | unidentified | 61,785 | 06 Mar. 1998 |
| rxa00620 | 1014 | GB_PL2:AF063247 | 1450 | AF063247 | Sequences from Patent WO9708323. | Pneumocystis carinii f. sp. ratti | 41,060 | 5 Jan. 1998 |
| | | GB_BA1:STMAPP | 2069 | M91546 | Pneumocystis carinii f. sp. ratti enolase mRNA, complete cds. | Streptomyces lividans | 37,126 | 12 Jun. 1993 |
| | | GB_HTG3:AC008763 | 214575 | AC008763 | Streptomyces lividans aminopeptidase P (PepP) gene, complete cds. | Homo sapiens | 40,020 | 3 Aug. 1999 |
| | | | | | Homo sapiens chromosome 19 clone CITB-E1_3214H19, **SEQUENCING IN PROGRESS*, 21 unordered pieces. | | | |
| rxa00624 | 810 | GB_IN1:CEY41E3 | 150641 | Z95559 | Caenorhabditis elegans cosmid Y41E3, complete sequence. | Caenorhabditis elegans | 36,986 | 2 Sep. 1999 |
| | | GB_EST13:AA362167 | 372 | AA362167 | EST71561 Macrophage I Homo sapiens cDNA 5' end, mRNA sequence. | Homo sapiens | 38,378 | 21 Apr. 1997 |
| | | GB_IN1:CEY41E3 | 150641 | Z95559 | Caenorhabditis elegans cosmid Y41E3, complete sequence. | Caenorhabditis elegans | 37,694 | 2 Sep. 1999 |
| rxa00626 | 1386 | GB_BA1:MTCY369 | 36850 | Z80226 | Mycobacterium tuberculosis H37Rv complete genome; segment 36/162. | Mycobacterium tuberculosis | 57,971 | 17 Jun. 1998 |
| | | GB_BA1:MLCB5 | 38109 | Z95151 | Mycobacterium leprae cosmid B5. | Mycobacterium leprae | 58,806 | 24 Jun. 1997 |
| | | GB_BA1:MLU15187 | 36138 | U15187 | Mycobacterium leprae cosmid L296. | Mycobacterium leprae | 38,007 | 09 Mar. 1995 |
| rxa00632 | 795 | GB_BA1:BRLBIOAD | 2272 | D14083 | Brevibacterium flavum genes for 7,8-diaminopelargonic acid aminotransferase and dethiobiotin synthetase, complete cds. | Corynebacterium glutamicum | 97,358 | 3 Feb. 1999 |
| | | GB_PAT:E04041 | 675 | E04041 | DNA sequence coding for desthiobiotinsynthetase. | Corynebacterium glutamicum | 98,074 | 29 Sep. 1997 |
| | | GB_PAT:E04040 | 1272 | E04040 | DNA sequence coding for diamino pelargonic acid aminotransferase. | Corynebacterium glutamicum | 93,814 | 29 Sep. 1997 |
| rxa00633 | 1392 | GB_BA1:BRLBIOAD | 2272 | D14083 | Brevibacterium flavum genes for 7,8-diaminopelargonic acid aminotransferase and dethiobiotin synthetase, complete cds. | Corynebacterium glutamicum | 95,690 | 3 Feb. 1999 |
| | | GB_PAT:E04040 | 1272 | E04040 | DNA sequence coding for diamino pelargonic acid aminotransferase. | Corynebacterium glutamicum | 95,755 | 29 Sep. 1997 |
| | | GB_BA2:EHU38519 | 1290 | U38519 | Erwinia herbicola adenosylmethionine-8-amino-7-oxononanoate transaminase (bioA) gene, complete cds. | Erwinia herbicola | 55,564 | 4 Nov. 1996 |
| rxa00688 | 666 | GB_BA1:MTV041 | 28826 | AL021958 | Mycobacterium tuberculosis H37Rv complete genome; segment 35/162. | Mycobacterium tuberculosis | 60,030 | 17 Jun. 1998 |
| | | GB_BA1:BRLSECY | 1516 | D14162 | Brevibacterium flavum gene for SecY protein (complete cds) and gene or adenylate kinase (partial cds). | Corynebacterium glutamicum | 99,563 | 3 Feb. 1999 |
| | | GB_BA2:MBU77912 | 7163 | U77912 | Mycobacterium bovis MBE50a gene, partial cds; and MBE50b, MBE50c, preprotein translocase SecY subunit (secY), adenylate kinase (adk), methionine aminopeptidase (map), RNA polymerase ECF sigma factor (sigE50), MBE50d, and MBE50e genes, complete cds. | Mycobacterium bovis | 60,030 | 27 Jan. 1999 |
| rxa00708 | 930 | GB_BA2:AF157493 | 25454 | AF157493 | Zymomonas mobilis ZM4 fosmid clone 42D7, complete sequence. | Zymomonas mobilis | 39,116 | 5 Jul. 1999 |
| | | GB_PAT:I00836 | 1853 | I00836 | Sequence 1 from U.S. Pat. No. 4758514. | Unknown. | 47,419 | 21 May 1993 |
| | | GB_PAT:E00311 | 1853 | E00311 | DNA coding of 2,5-diketogluconic acid reductase. | unidentified | 47,419 | 29 Sep. 1997 |
| rxa00717 | 1083 | GB_PAT:I78753 | 1187 | I78753 | Sequence 9 from U.S. Pat. No. 5693781. | Unknown. | 37,814 | 3 Apr. 1998 |
| | | GB_PAT:I92042 | 1187 | I92042 | Sequence 9 from U.S. Pat. No. 5726299. | Unknown. | 37,814 | 01 Dec. 1998 |
| | | GB_BA1:MTCI125 | 37432 | Z98268 | Mycobacterium tuberculosis H37Rv complete genome; segment 76/162. | Mycobacterium tuberculosis | 50,647 | 17 Jun. 1998 |
| rxa00718 | 831 | GB_BA1:MTCI125 | 37432 | Z98268 | Mycobacterium tuberculosis H37Rv complete genome; segment 76/162. | Mycobacterium tuberculosis | 55,228 | 17 Jun. 1998 |
| | | GB_BA1:MTCI125 | 37432 | Z98268 | Mycobacterium tuberculosis H37Rv complete genome; segment 76/162. | Mycobacterium tuberculosis | 40,300 | 17 Jun. 1998 |
| | | GB_GSS12:AQ420755 | 671 | AQ420755 | RPCI-11-168G18.TJ RPCI-11 Homo sapiens genomic clone RPCI-11-168G18, genomic survey sequence. | Homo sapiens | 35,750 | 23 Mar. 1999 |
| rxa00727 | 1035 | GB_HTG3:AC008332 | 118545 | AC008332 | Drosophila melanogaster chromosome 2 clone BACR48D10 (D867) RPCI-98 48.D.10 map 34A-34A strain y; cn bw sp, **SEQUENCING IN PROGRESS*, 78 unordered pieces. | Drosophila melanogaster | 40,634 | 6 Aug. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG3:AC008332 | 118545 | AC008332 | *Drosophila melanogaster* chromosome 2 clone BACR48D10 (D867) RPCI-98 48.D.10 map 34A-34A strain y; cn bw sp, *SEQUENCING IN PROGRESS*, 78 unordered pieces. | *Drosophila melanogaster* | 40,634 | 6 Aug. 1999 |
| | | GB_HTG3:AC008332 | 118545 | AC008332 | *Drosophila melanogaster* chromosome 2 clone BACR48D10 (D867) RPCI-98 48.D.10 map 34A-34A strain y; cn bw sp, *SEQUENCING IN PROGRESS*, 78 unordered pieces. | *Drosophila melanogaster* | 33,888 | 6 Aug. 1999 |
| rxa00766 | 966 | GB_HTG2:AC006789 | 83823 | AC006789 | *Caenorhabditis elegans* clone Y49F6, *SEQUENCING IN PROGRESS*, 2 unordered pieces. | *Caenorhabditis elegans* | 36,737 | 25 Feb. 1999 |
| | | GB_HTG2:AC006789 | 83823 | AC006789 | *Caenorhabditis elegans* clone Y49F6, *SEQUENCING IN PROGRESS*, 2 unordered pieces. | *Caenorhabditis elegans* | 36,737 | 25 Feb. 1999 |
| rxa00770 | 1293 | GB_BA1:D90810 | 20476 | D90810 | *E. coli* genomic DNA, Kohara clone #319(37.4-37.8 min.). | *Escherichia coli* | 36,526 | 29 May 1997 |
| | | GB_BA1:MTV043 | 68848 | AL022004 | *Mycobacterium tuberculosis* H37Rv complete genome; segment 40/162. | *Mycobacterium tuberculosis* | 66,193 | 24 Jun. 1999 |
| | | GB_BA1:MLU15182 | 40123 | U15182 | *Mycobacterium leprae* cosmid B2266. | *Mycobacterium leprae* | 61,443 | 09 Mar. 1995 |
| | | GB_BA2:SCD25 | 41622 | AL118514 | *Streptomyces coelicolor* cosmid D25. | *Streptomyces coelicolor* A3(2) | 59,938 | 21 Sep. 1999 |
| rxa00779 | 1056 | GB_HTG1:CER08A5 | 51920 | Z82281 | *Caenorhabditis elegans* chromosome V clone R08A5, *SEQUENCING IN PROGRESS*, in unordered pieces. | *Caenorhabditis elegans* | 64,896 | 14 Oct. 1998 |
| | | GB_HTG1:CER08A5 | 51920 | Z82281 | *Caenorhabditis elegans* chromosome V clone R08A5, *SEQUENCING IN PROGRESS*, in unordered pieces. | *Caenorhabditis elegans* | 64,896 | 14 Oct. 1998 |
| | | GB_PL2:AF078693 | 1492 | AF078693 | *Chlamydomonas reinhardtii* putative O-acetylserine(thiol)lyase precursor (Crcys-1A) mRNA, nuclear gene encoding organellar protein, complete cds. | *Chlamydomonas reinhardtii* | 57,970 | 3 Nov. 1999 |
| rxa00780 | 669 | GB_BA1:MTCY98 | 31225 | Z83860 | *Mycobacterium tuberculosis* H37Rv complete genome; segment 103/162. | *Mycobacterium tuberculosis* | 54,410 | 17 Jun. 1998 |
| | | GB_BA1:AVINIFREG | 7099 | M60090 | *Azotobacter chroococcum* nifU, nifS, nifV, nifP, nifW, nifZ and nifM genes, complete cds. | *Azotobacter chroococcum* | 51,729 | 26 Apr. 1993 |
| rxa00838 | 6701 | GB_BA2:AF001780 | 6701 | AF001780 | *Cyanothece* PCC 8801 NifP (nifP), nitrogenase (nifB), FdxN (fdxN), NifS (nifS) and NifU (nifU) genes, complete cds, and NifH (nifH) gene, partial cds. | *Cyanothece* PCC8801 | 36,309 | 08 Mar. 1999 |
| | | GB_EST1:Z30506 | 329 | Z30506 | ATTS2430 AC16H *Arabidopsis thaliana* cDNA clone TAI306 3'; mRNA sequence. | *Arabidopsis thaliana* | 44,308 | 11 Mar. 1994 |
| | | GB_PL2:AC006258 | 110469 | AC006258 | *Arabidopsis thaliana* BAC F18G18 from chromosome V near 60.5 cM, complete sequence. | *Arabidopsis thaliana* | 35,571 | 28 Dec. 1998 |
| | | GB_EST37:AI998439 | 455 | AI998439 | 701545695 *A. thaliana*, Columbia Col-0, rosette-2 *Arabidopsis thaliana* cDNA clone 701545695, mRNA sequence. | *Arabidopsis thaliana* | 36,044 | 8 Sep. 1999 |
| rxa00863 | 867 | GB_BA1:BLDAPAB | 3572 | Z21502 | *B. lactofermentum* dapA and dapB genes for dihydrodipicolinate synthase and dihydrodipicolinate reductase. | *Corynebacterium glutamicum* | 99,539 | 16 Aug. 1993 |
| | | GB_PAT:E16749 | 2001 | E16749 | gDNA encoding dihydrodipicolinate synthase (DDPS). | *Corynebacterium glutamicum* | 99,539 | 28 Jul. 1999 |
| | | GB_PAT:E14520 | 2001 | E14520 | DNA encoding *Brevibacterium* dihydrodipicolinic acid synthase. | *Corynebacterium glutamicum* | 99,539 | 28 Jul. 1999 |
| rxa00864 | 873 | GB_BA1:BLDAPAB | 3572 | Z21502 | *B. lactofermentum* dapA and dapB genes for dihydrodipicolinate synthase and dihydrodipicolinate reductase. | *Corynebacterium glutamicum* | 99,885 | 16 Aug. 1993 |
| rxa00865 | 1026 | GB_BA1:CGDAPB | 1902 | X67737 | *C. glutamicum* dapB gene for dihydrodipicolinate reductase. | *Corynebacterium glutamicum* | 100,000 | 1 Apr. 1993 |
| | | GB_PAT:E14520 | 2001 | E14520 | DNA encoding *Brevibacterium* dihydrodipicolinic acid synthase. | *Corynebacterium glutamicum* | 100,000 | 28 Jul. 1999 |
| | | GB_BA1:BLDAPAB | 3572 | Z21502 | *B. lactofermentum* dapA and dapB genes for dihydrodipicolinate synthase and dihydrodipicolinate reductase. | *Corynebacterium glutamicum* | 100,000 | 16 Aug. 1993 |
| rxa00867 | 650 | GB_PAT:E16752 | 1411 | E16752 | gDNA encoding dihydrodipicolinate reductase (DDPR). | *Corynebacterium glutamicum* | 99,805 | 28 Jul. 1999 |
| | | GB_PAT:AR038113 | 1411 | AR038113 | Sequence 18 from U.S. Pat. No. 5804414. | Unknown. | 99,805 | 29 Sep. 1999 |
| | | GB_BA1:MTV002 | 56414 | AL008967 | *Mycobacterium tuberculosis* H37Rv complete genome; segment 122/162. | *Mycobacterium tuberculosis* | 39,179 | 17 Jun. 1998 |
| | | GB_BA1:MLCB22 | 40281 | Z98741 | *Mycobacterium leprae* cosmid B22. | *Mycobacterium leprae* | 39,482 | 22 Aug. 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00873 | 2838 | GB_BA1:SAU19858 | 779 | U19858 | *Streptomyces antibioticus* guanosine pentaphosphate synthetase (gpsI) gene, complete cds. | *Streptomyces antibioticus* | 69,706 | 25 Oct. 1996 |
| | | GB_BA1:SCO001206 | 9184 | AJ001206 | *Streptomyces coelicolor* A3(2), glycogen metabolism clusterII. | *Streptomyces coelicolor* | 63,415 | 29 Mar. 1999 |
| | | GB_BA1:SCO001205 | 9589 | AJ001205 | *Streptomyces coelicolor* A3(2) glycogen metabolism clusterI. | *Streptomyces coelicolor* | 61,617 | 29 Mar. 1999 |
| | | GB_BA1:D78198 | 2304 | D78198 | *Pimelobacter* sp. DNA for trehalose synthase, complete cds. | *Pimelobacter* sp. | 60,594 | 5 Feb. 1999 |
| rxa00884 | 1263 | GB_BA1:MTCY253 | 41230 | Z81368 | *Mycobacterium tuberculosis* H37Rv complete genome; segment 106/162. | *Mycobacterium tuberculosis* | 37,785 | 17 Jun. 1998 |
| | | GB_BA1:MSGY222 | 41156 | AD000010 | *Mycobacterium tuberculosis* sequence from clone y222. | *Mycobacterium tuberculosis* | 38,006 | 03 Dec. 1996 |
| | | GB_GSS15:AQ654600 | 468 | AQ654600 | Sheared DNA-1O14, TF Sheared DNA *Trypanosoma brucei* genomic clone Sheared DNA-1O14, genomic survey sequence. | *Trypanosoma brucei* | 33,974 | 22 Jun. 1999 |
| rxa00891 | 1102 | GB_BA1:MTCI418B | 11700 | Z96071 | *Mycobacterium tuberculosis* H37Rv complete genome; segment 7/162. | *Mycobacterium tuberculosis* | 63,297 | 18 Jun. 1998 |
| | | GB_BA1:SCO001206 | 9184 | AJ001206 | *Streptomyces coelicolor* A3(2), glycogen metabolism clusterII. | *Streptomyces coelicolor* | 61,965 | 29 Mar. 1999 |
| | | GB_BA1:SCO001205 | 9589 | AJ001205 | *Streptomyces coelicolor* A3(2) glycogen metabolism clusterI. | *Streptomyces coelicolor* | 61,727 | 29 Mar. 1999 |
| rxa00952 | 963 | EM_PAT:E10963 | 3118 | E10963 | gDNA encoding tryptophan synthase. | *Corynebacterium glutamicum* | 99,688 | 08 Oct. 1997 (Rel. 52, Created) |
| rxa00954 | 644 | GB_BA1:BLTRP | 7725 | X04960 | *Brevibacterium lactofermentum* tryptophan operon. | *Corynebacterium glutamicum* | 98,847 | 10 Feb. 1999 |
| | | GB_PAT:E01375 | 7726 | E01375 | Genomic DNA of trp operon of prepibacterium latophelmentamn. | unidentified | 98,428 | 29 Sep. 1997 |
| | | GB_PAT:E01688 | 7725 | E01688 | DNA sequence of tryptophan operon. | *Corynebacterium glutamicum* | 98,758 | 29 Sep. 1997 |
| | | GB_PAT:E01375 | 7726 | E01375 | Genomic DNA of trp operon of prepibacterium latophelmentamn. | unidentified | 98,758 | 29 Sep. 1997 |
| rxa00955 | 1545 | GB_BA1:BLTRP | 7725 | X04960 | *Brevibacterium lactofermentum* tryptophan operon. | *Corynebacterium glutamicum* | 98,758 | 10 Feb. 1999 |
| | | GB_PAT:E01375 | 7726 | E01375 | DNA sequence of tryptophan operon. | *Corynebacterium glutamicum* | 98,372 | 29 Sep. 1997 |
| | | GB_BA1:BLTRP | 7725 | X04960 | *Brevibacterium lactofermentum* tryptophan operon. | *Corynebacterium glutamicum* | 98,372 | 10 Feb. 1999 |
| | | GB_PAT:E01688 | 7725 | E01688 | Genomic DNA of trp operon of prepibacterium latophelmentamn. | unidentified | 98,242 | 29 Sep. 1997 |
| rxa00956 | 1237 | EM_PAT:E10963 | 3118 | E10963 | gDNA encoding tryptophan synthase. | *Corynebacterium glutamicum* | 98,949 | 08 Oct. 1997 (Rel. 52, Created) |
| rxa00957 | 1677 | GB_BA1:BLTRP | 7725 | X04960 | *Brevibacterium lactofermentum* tryptophan operon. | *Corynebacterium glutamicum* | 99,107 | 10 Feb. 1999 |
| | | GB_PAT:E01375 | 7726 | E01375 | DNA sequence of tryptophan operon. | *Corynebacterium glutamicum* | 98,945 | 29 Sep. 1997 |
| | | GB_BA1:BLTRP | 7725 | X04960 | *Brevibacterium lactofermentum* tryptophan operon. | *Corynebacterium glutamicum* | 99,165 | 10 Feb. 1999 |
| | | GB_PAT:E01375 | 7726 | E01375 | DNA sequence of tryptophan operon. | *Corynebacterium glutamicum* | 98,927 | 29 Sep. 1997 |
| | | GB_PAT:E01688 | 7725 | E01688 | Genomic DNA of trp operon of prepibacterium latophelmentamn. | unidentified | 98,867 | 29 Sep. 1997 |
| rxa00958 | 747 | GB_BA1:BLTRP | 7725 | X04960 | *Brevibacterium lactofermentum* tryptophan operon. | *Corynebacterium glutamicum* | 98,792 | 10 Feb. 1999 |
| | | GB_PAT:E01375 | 7726 | E01375 | DNA sequence of tryptophan operon. | *Corynebacterium glutamicum* | 98,792 | 29 Sep. 1997 |
| | | GB_PAT:E01688 | 7725 | E01688 | Genomic DNA of trp operon of prepibacterium latophelmentamn. | unidentified | 98,658 | 29 Sep. 1997 |
| rxa00970 | 1050 | GB_BA1:CGHOMTHR | 3685 | Y00546 | *Corynebacterium glutamicum* hom-thrB genes for homoserine dehydrogenase and homoserine kinase. | *Corynebacterium glutamicum* | 99,905 | 12 Sep. 1993 |
| | | GB_PAT:I09077 | 3685 | I09077 | Sequence 1 from Patent WO 8809819. | Unknown. | 99,810 | 02 Dec. 1994 |
| | | GB_PAT:E01358 | 2615 | E01358 | DNA encoding for homoserine dehydrogenase(HDH)and homoserine kinase(HK). | *Corynebacterium glutamicum* | 97,524 | 29 Sep. 1997 |
| rxa00972 | 1458 | GB_PAT:E16755 | 3579 | E16755 | gDNA encoding diaminopimelate decarboxylase (DDC) and arginyl-tRNA synthase. | *Corynebacterium glutamicum* | 99,931 | 28 Jul. 1999 |
| | | GB_PAT:AR038110 | 3579 | AR038110 | Sequence 15 from U.S. Pat. No. 5804414. | Unknown. | 99,931 | 29 Sep. 1999 |
| | | GB_PAT:E14508 | 3579 | E14508 | DNA encoding *Brevibacterium* diaminopimelic acid decarboxylase and arginyl-tRNA synthase. | *Corynebacterium glutamicum* | 99,931 | 28 Jul. 1999 |
| rxa00981 | 753 | GB_OV:GGA245664 | 512 | AJ245664 | *Gallus gallus* partial mRNA for ATP-citrate lyase (ACL gene). | *Gallus gallus* | 37,538 | 28 Sep. 1999 |

TABLE 4-continued

ALIGNMENT RESULTS

| ID # | length (NT) | GenBank Hit | Genbank Accession | Name of Genbank Hit | Source of Genbank Hit | % homology (GAP) | Date of Deposit |
|---|---|---|---|---|---|---|---|
| rxa00989 | | GB_PL2:AC007887 | 159434 AC007887 | Genomic sequence for *Arabidopsis thaliana* BAC F15O4 from chromosome I, complete sequence. | *Arabidopsis thaliana* | 37,600 | 04 Oct. 1999 |
| | | GB_GSS1:CNS00RNW | 542 AL087338 | *Arabidopsis thaliana* genome survey sequence T7 end of BAC F14D7 of IGF library from strain Columbia of *Arabidopsis thaliana*, genomic survey sequence. | *Arabidopsis thaliana* | 41,264 | 28 Jun. 1999 |
| rxa00997 | 1644 | GB_BA1:MTV008 | 63033 AL021246 | *Mycobacterium tuberculosis* H37Rv complete genome; segment 108/162. | *Mycobacterium tuberculosis* | 40,773 | 17 Jun. 1998 |
| | | GB_BA1:SCVALSFP | 3619 Y13070 | S. coelicolor valS, fpgs, ndk genes. | *Streptomyces coelicolor* | 58,119 | 03 Mar. 1998 |
| | | GB_BA1:MTV008 | 63033 AL021246 | *Mycobacterium tuberculosis* H37Rv complete genome; segment 108/162. | *Mycobacterium tuberculosis* | 38,167 | 17 Jun. 1998 |
| | 705 | GB_BA2:CGU31225 | 1817 U31225 | *Corynebacterium glutamicum* L-proline:NADP+ 5-oxidoreductase (proC) gene, complete cds. | *Corynebacterium glutamicum* | 40,841 | 2 Aug. 1996 |
| rxa01019 | | GB_HTG1:CEY39C12 | 282838 AL009026 | *Caenorhabditis elegans* chromosome IV clone Y39C12, **SEQUENCING IN PROGRESS**, in unordered pieces. | *Caenorhabditis elegans* | 36,416 | 26 Oct. 1999 |
| | | GB_IN1:CEB0001 | 39416 Z69634 | *Caenorhabditis elegans* cosmid B0001, complete sequence. | *Caenorhabditis elegans* | 36,416 | 2 Sep. 1999 |
| | | GB_HTG2:AC005052 | 144734 AC005052 | *Homo sapiens* clone RG038K21, **SEQUENCING IN PROGRESS**, 3 unordered pieces. | *Homo sapiens* | 39,172 | 12 Jun. 1998 |
| | 1110 | GB_HTG2:AC005052 | 144734 AC005052 | *Homo sapiens* clone RG038K21, **SEQUENCING IN PROGRESS**, 3 unordered pieces. | *Homo sapiens* | 39,172 | 12 Jun. 1998 |
| | | GB_GSS9:AQ171808 | 512 AQ171808 | HS_3179_A1_G03_T7 CIT Approved Human Genomic Sperm Library D *Homo sapiens* genomic clone Plate = 3179 Col = 5 Row = M, genomic survey sequence. | *Homo sapiens* | 34,661 | 17 Oct. 1998 |
| rxa01026 | 1782 | GB_BA1:SC1C2 | 42210 AL031124 | *Streptomyces coelicolor* cosmid 1C2. | *Streptomyces coelicolor* | 68,275 | 15 Jan. 1999 |
| | | GB_BA1:ATLEUCD | 2982 X84647 | A. teichomyceticus leuC and leuD genes. | *Actinoplanes teichomyceticus* | 65,935 | 04 Oct. 1995 |
| | | GB_BA1:MTV012 | 70287 AL021287 | *Mycobacterium tuberculosis* H37Rv complete genome; segment 132/162. | *Mycobacterium tuberculosis* | 40,454 | 23 Jun. 1999 |
| rxa01027 | 1131 | GB_BA1:MLCB637 | 44882 Z99263 | *Mycobacterium leprae* cosmid B637. | *Mycobacterium leprae* | 38,636 | 17 Sep. 1997 |
| | | GB_BA1:MTCY349 | 43523 Z83018 | *Mycobacterium tuberculosis* H37Rv complete genome; segment 131/162. | *Mycobacterium tuberculosis* | 51,989 | 17 Jun. 1998 |
| | | GB_BA1:SPUNGMUTX | 1172 Z21702 | S. pneumoniae ung gene and mutX genes encoding uracil-DNA glycosylase and 8-oxodGTP nucleoside triphosphatase. | *Streptococcus pneumoniae* | 38,088 | 15 Jun. 1994 |
| rxa01073 | 954 | GB_BA1:BACOUTB | 1004 M15811 | *Bacillus subtilis* outB gene encoding a sporulation protein, complete cds. | *Bacillus subtilis* | 53,723 | 26 Apr. 1993 |
| | | GB_PR4:AC007938 | 167237 AC007938 | *Homo sapiens* clone UWGC: djs201 from 7q21, complete sequence. | *Homo sapiens* | 34,322 | 1 Jul. 1999 |
| | | GB_PL2:ATAC006282 | 92577 AC006282 | *Arabidopsis thaliana* chromosome II BAC F13K3 genomic sequence, complete sequence. | *Arabidopsis thaliana* | 36,181 | 13 Mar. 1999 |
| rxa01079 | 2226 | GB_BA2:AF112535 | 4363 AF112535 | *Corynebacterium glutamicum* putative glutaredoxin NrdH (nrdH), Nrdl (nrdI), and ribonucleotide reductase alpha-chain (nrdE) genes, complete cds. | *Corynebacterium glutamicum* | 99,820 | 5 Aug. 1999 |
| | | GB_BA1:CANRDFGEN | 6054 Y09572 | *Corynebacterium ammoniagenes* nrdH, nrdI, nrdE, nrdF genes. | *Corynebacterium ammoniagenes* | 75,966 | 18 Apr. 1998 |
| rxa01080 | 567 | GB_BA1:MTV012 | 70287 AL021287 | *Mycobacterium tuberculosis* H37Rv complete genome; segment 132/162. | *Mycobacterium tuberculosis* | 38,296 | 23 Jun. 1999 |
| | | GB_BA2:AF112535 | 4363 AF112535 | *Corynebacterium glutamicum* putative glutaredoxin NrdH (nrdH), Nrdl (nrdI), and ribonucleotide reductase alpha-chain (nrdE) genes, complete cds. | *Corynebacterium glutamicum* | 100,000 | 5 Aug. 1999 |
| | | GB_BA1:CANRDFGEN | 6054 Y09572 | *Corynebacterium ammoniagenes* nrdH, nrdI, nrdE, nrdF genes. | *Corynebacterium ammoniagenes* | 65,511 | 18 Apr. 1998 |
| rxa01087 | 999 | GB_BA1:STNRD | 4894 X73226 | S. typhimurium nrdEF operon. | *Salmonella typhimurium* | 52,477 | 03 Mar. 1997 |
| | | GB_IN2:AF063412 | 1093 AF063412 | *Limnadia lenticularis* elongation factor 1-alpha mRNA, partial cds. | *Limnadia lenticularis* | 43,750 | 29 Jun. 1999 |
| | | GB_PR3:HS24M15 | 134539 Z94055 | Human DNA sequence from PAC 24M15 on chromosome 1. Contains tenascin-R (restrictin), EST. | *Homo sapiens* | 37,475 | 23 Nov. 1999 |
| rxa01095 | 857 | GB_IN2:ARU85702 | 1240 U85702 | *Anathix ralla* elongation factor-1 alpha (EF-1a) gene, partial cds. | *Anathix ralla* | 37,319 | 16 Jul. 1997 |
| | | GB_BA1:MTCY01B2 | 35938 Z95554 | *Mycobacterium tuberculosis* H37Rv complete genome; segment 72/162. | *Mycobacterium tuberculosis* | 43,243 | 17 Jun. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG5:AC011632 | 175917 | AC011632 | Homo sapiens clone RP11-3N13, WORKING DRAFT SEQUENCE, 9 unordered pieces. | Homo sapiens | 36,471 | 19 Nov. 1999 |
| | | GB_HTG5:AC011632 | 175917 | AC011632 | Homo sapiens clone RP11-3N13, WORKING DRAFT SEQUENCE, 9 unordered pieces. | Homo sapiens | 36,836 | 19 Nov. 1999 |
| rxa01097 | 477 | GB_BA2:AF030405 | 774 | AF030405 | Corynebacterium glutamicum cyclase (hisF) gene, complete cds. | Corynebacterium glutamicum | 100,000 | 13 Nov. 1997 |
| | | GB_BA2:AF030405 | 774 | AF030405 | Corynebacterium glutamicum cyclase (hisF) gene, complete cds. | Corynebacterium glutamicum | 41,206 | 13 Nov. 1997 |
| rxa01098 | 897 | GB_BA2:AF030405 | 774 | AF030405 | Corynebacterium glutamicum cyclase (hisF) gene, complete cds. | Corynebacterium glutamicum | 97,933 | 13 Nov. 1997 |
| | | GB_BA1:MSGY223 | 42061 | AD000019 | Mycobacterium tuberculosis sequence from clone y223. | Mycobacterium tuberculosis | 40,972 | 10 Dec. 1996 |
| | | GB_BA1:MLCB1610 | 40055 | AL049913 | Mycobacterium leprae cosmid B1610. | Mycobacterium leprae | 61,366 | 27 Aug. 1999 |
| rxa01100 | 861 | GB_BA2:AF051846 | 738 | AF051846 | Corynebacterium glutamicum phosphoribosylformimino-5-amino-1-phosphoribosyl-4-imidazolecarboxamide isomerase (hisA) gene, complete cds. | Corynebacterium glutamicum | 97,154 | 12 Mar. 1998 |
| | | GB_BA2:AF060558 | 636 | AF060558 | Corynebacterium glutamicum glutamine amidotransferase (hisH) gene, complete cds. | Corynebacterium glutamicum | 95,455 | 29 Apr. 1998 |
| | | GB_HTG1:HSDJ140A9 | 221755 | AL109917 | Homo sapiens chromosome 1 clone RP1-140A9, *SEQUENCING IN PROGRESS*, in unordered pieces. | Homo sapiens | 30,523 | 23 Nov. 1999 |
| rxa01101 | 756 | GB_BA2:AF060558 | 636 | AF060558 | Corynebacterium glutamicum glutamine amidotransferase (hisH) gene, complete cds. | Corynebacterium glutamicum | 94,462 | 29 Apr. 1998 |
| | | GB_BA1:SC4G6 | 36917 | AL096884 | Streptomyces coelicolor cosmid 4G6. | Streptomyces coelicolor A3(2) | 38,378 | 23 Jul. 1999 |
| | | GB_BA1:STMHISOPA | 3981 | M31628 | S. coelicolor histidine biosynthesis operon encoding hisD, partial cds, and hisC, hisB, hisH, and hisA genes, complete cds. | Streptomyces coelicolor | 60,053 | 26 Apr. 1993 |
| rxa01104 | 729 | GB_BA1:STMHISOPA | 3981 | M31628 | S. coelicolor histidine biosynthesis operon encoding hisD, partial cds, and hisC, hisB, hisH, and hisA genes, complete cds. | Streptomyces coelicolor | 58,333 | 26 Apr. 1993 |
| | | GB_BA1:SC4G6 | 36917 | AL096884 | Streptomyces coelicolor cosmid 4G6. | Streptomyces coelicolor A3(2) | 39,045 | 23 Jul. 1999 |
| | | GB_BA1:MTCY336 | 32437 | Z95586 | Mycobacterium tuberculosis H37Rv complete genome; segment 70/162. | Mycobacterium tuberculosis | 60,364 | 24 Jun. 1999 |
| rxa01105 | 1221 | GB_BA1:MTCY336 | 32437 | Z95586 | Mycobacterium tuberculosis H37Rv complete genome; segment 70/162. | Mycobacterium tuberculosis | 60,931 | 24 Jun. 1999 |
| | | GB_BA1:MSGY223 | 42061 | AD000019 | Mycobacterium tuberculosis sequence from clone y223. | Mycobacterium tuberculosis | 36,851 | 10 Dec. 1996 |
| | | GB_BA1:MLCB1610 | 40055 | AL049913 | Mycobacterium leprae cosmid B1610. | Mycobacterium leprae | 60,902 | 27 Aug. 1999 |
| rxa01106 | 1449 | GB_BA1:MSGY223 | 42061 | AD000019 | Mycobacterium tuberculosis sequence from clone y223. | Mycobacterium tuberculosis | 37,233 | 10 Dec. 1996 |
| | | GB_BA1:MSHISCD | 2298 | X65542 | M. smegmatis genes hisD and hisC for histidinol dehydrogenase and histidinol-phosphate aminotransferase, respectively. | Mycobacterium smegmatis | 60,111 | 30 Jun. 1993 |
| | | GB_BA1:MTCY336 | 32437 | Z95586 | Mycobacterium tuberculosis H37Rv complete genome; segment 70/162. | Mycobacterium tuberculosis | 58,420 | 24 Jun. 1999 |
| rxa01145 | 1137 | GB_BA1:CORA1A | 4705 | L09232 | Corynebacterium glutamicum acetohydroxy acid synthase (ilvB) and (ilvN) genes, and acetohydroxy acid isomeroreductase (ilvC) gene, complete cds. | Corynebacterium glutamicum | 100,000 | 23 Feb. 1995 |
| | | GB_BA1:BRLILVCA | 1364 | D14551 | Brevibacterium flavum ilvC gene for acetohydroxy acid isomeroreductase, complete cds. | Corynebacterium glutamicum | 99,560 | 3 Feb. 1999 |
| rxa01162 | 1449 | GB_PAT:E08232 | 1017 | E08232 | DNA encoding acetohydroxy-acid isomeroreductase. | Corynebacterium glutamicum | 99,803 | 29 Sep. 1997 |
| | | GB_PAT:A60299 | 2869 | A60299 | Sequence 18 from Patent WO9706261. | Aspergillus niger | 38,675 | 06 Mar. 1998 |
| | | GB_PR3:HS24E5 | 35506 | Z82185 | Human DNA sequence from Fosmid 24E5 on chromosome 22q11.2-qter contains parvalbumin, ESTs, STS. | Homo sapiens | 36,204 | 23 Nov. 1999 |
| rxa01208 | 846 | GB_PR3:AC005265 | 43900 | AC005265 | Homo sapiens chromosome 19, cosmid F19750, complete sequence. | Homo sapiens | 38,363 | 6 Jul. 1998 |
| | | GB_HTG2:AC004965 | 323792 | AC004965 | Homo sapiens clone DJ1106H14, **SEQUENCING IN PROGRESS**, 42 unordered pieces. | Homo sapiens | 36,058 | 12 Jun. 1998 |
| | | GB_HTG2:AC004965 | 323792 | AC004965 | Homo sapiens clone DJ1106H14, **SEQUENCING IN PROGRESS**, 42 unordered pieces. | Homo sapiens | 36,058 | 12 Jun. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01209 | 1528 | GB_PL2:TAU55859 | 2397 | U55859 | *Triticum aestivum* heat shock protein 80 mRNA, complete cds. | *Triticum aestivum* | 37,269 | 1 Feb. 1999 |
| | | GB_HTG3:AC011469 | 113436 | AC011469 | *Homo sapiens* chromosome 19 clone CIT-HSPC_475D23, *SEQUENCING IN PROGRESS*, 31 unordered pieces. | *Homo sapiens* | 40,000 | 07 Oct. 1999 |
| | | GB_HTG3:AC011469 | 113436 | AC011469 | *Homo sapiens* chromosome 19 clone CIT-HSPC_475D23, *SEQUENCING IN PROGRESS*, 31 unordered pieces. | *Homo sapiens* | 40,000 | 07 Oct. 1999 |
| | | GB_PL1:AB010077 | 77380 | AB010077 | *Arabidopsis thaliana* genomic DNA, chromosome 5, P1 clone: MYH19, complete sequence. | *Arabidopsis thaliana* | 36,803 | 20 Nov. 1999 |
| rxa01215 | 1098 | GB_BA1:MTCY10G2 | 38970 | Z92539 | *Mycobacterium tuberculosis* H37Rv complete genome; segment 47/162. | *Mycobacterium tuberculosis* | 37,047 | 17 Jun. 1998 |
| | | GB_IN1:LEIPRPP | 1887 | M76553 | *Leishmania donovani* phosphoribosylpyrophosphate synthetase gene, complete cds. | *Leishmania donovani* | 50,738 | 7 Jun. 1993 |
| | | GB_HTG2:HSJ799D16 | 130149 | AL050344 | *Homo sapiens* chromosome 1 clone RP4-799D16 map p34.3-36.1, *SEQUENCING IN PROGRESS*, in unordered pieces. | *Homo sapiens* | 38,135 | 29 Nov. 1999 |
| rxa01239 | 2556 | GB_BA1:MTCY48 | 35377 | Z74020 | *Mycobacterium tuberculosis* H37Rv complete genome; segment 69/162. | *Mycobacterium tuberculosis* | 38,139 | 17 Jun. 1998 |
| | | GB_PR2:AB029032 | 6377 | AB029032 | *Homo sapiens* mRNA for KIAA1109 protein, partial cds. | *Homo sapiens* | 39,394 | 4 Aug. 1999 |
| | | GB_GSS9:AQ107201 | 355 | AQ107201 | HS_3098_A1_C03_T7 CIT Approved Human Genomic Sperm Library D *Homo sapiens* genomic clone Plate = 3098 Col = 5 Row = E, genomic survey sequence. | *Homo sapiens* | 41,408 | 28 Aug. 1998 |
| rxa01253 | 873 | GB_PL2:F5O8 | 99923 | AC005990 | *Arabidopsis thaliana* chromosome 1 BAC F5O8 sequence, complete sequence. | *Arabidopsis thaliana* | 36,118 | 23 Dec. 1998 |
| | | GB_PL2:F5O8 | 99923 | AC005990 | *Arabidopsis thaliana* chromosome 1 BAC F5O8 sequence, complete sequence. | *Arabidopsis thaliana* | 35,574 | 23 Dec. 1998 |
| rxa01321 | 1044 | GB_IN1:CELC06G1 | 31205 | U41014 | *Caenorhabditis elegans* cosmid C06G1. | *Caenorhabditis elegans* | 38,560 | 30 Nov. 1995 |
| | | GB_GSS14:AQ518843 | 441 | AQ518843 | HS_5106_A1_D10_SP6E RPCI-11 Human Male BAC Library *Homo sapiens* genomic clone Plate = 682 Col = 19 Row = G, genomic survey sequence. | *Homo sapiens* | 41,121 | 05 May 1999 |
| | | GB_HTG2:AC007473 | 194859 | AC007473 | *Drosophila melanogaster* chromosome 2 clone BACR38D12 (D590) RPCI-98 38.D.12 map 48A-48B strain y; cn bw sp, **SEQUENCING IN PROGRESS**, 60 unordered pieces. | *Drosophila melanogaster* | 40,634 | 2 Aug. 1999 |
| | | GB_HTG4:AC011696 | 115847 | AC011696 | *Drosophila melanogaster* chromosome 2 clone BACR35F01 (D1156) RPCI-98 35.F.1 map 48A-48C strain y; cn bw sp, *SEQUENCING IN PROGRESS*, 108 unordered pieces. | *Drosophila melanogaster* | 38,290 | 26 Oct. 1999 |
| rxa01352 | 706 | GB_PL2:ATAC005167 | 83260 | AC005167 | *Arabidopsis thaliana* chromosome II BAC F12A24 genomic sequence, complete sequence. | *Arabidopsis thaliana* | 34,311 | 15 Oct. 1998 |
| | | GB_PL2:ATAC005825 | 97380 | AC005825 | *Arabidopsis thaliana* chromosome II BAC T24I21 genomic sequence, complete sequence. | *Arabidopsis thaliana* | 34,311 | 12 Apr. 1999 |
| rxa01360 | 259 | GB_HTG3:AC011150 | 127222 | AC011150 | *Homo sapiens* clone 4_K_17, LOW-PASS SEQUENCE SAMPLING. | *Homo sapiens* | 37,722 | 01 Oct. 1999 |
| | | GB_EST32:AI725583 | 728 | AI725583 | BNLGHi12371 Six-day Cotton fiber *Gossypium hirsutum* cDNA 5' similar to (U86081) root hair defective 3 [*Arabidopsis thaliana*], mRNA sequence. | *Gossypium hirsutum* | 38,492 | 11 Jun. 1999 |
| | | GB_PR2:HS227P17 | 82951 | Z81007 | Human DNA sequence from PAC 227P17, between markers DXS6791 andDXS8038 on chromosome X contains CpG island, EST. | *Homo sapiens* | 39,738 | 23 Nov. 1999 |
| | | GB_EST34:AV171099 | 173 | AV171099 | AV171099 *Mus musculus* head C57BL/6l 14, 17 day embryo *Mus musculus* cDNA clone 3200002M11, mRNA sequence. | *Mus musculus* | 46,237 | 6 Jul. 1999 |
| rxa01361 | 629 | GB_RO:AB008915S1 | 530 | AB008915 | *Mus musculus* mGpi1 gene, exon 1. | *Mus musculus* | 45,574 | 28 Sep. 1999 |
| | | GB_EST22:AI050532 | 293 | AI050532 | uc83d10.y1 Sugano mouse kidney mkia *Mus musculus* cDNA clone IMAGE:1432243 5' similar to TR: O35120 O35120 MGPI1P;, mRNA sequence. | *Mus musculus* | 44,097 | 9 Jul. 1998 |
| | | GB_RO:AB008895 | 3062 | AB008895 | *Mus musculus* mRNA for mGpi1p, complete cds. | *Mus musculus* | 41,316 | 23 Nov. 1997 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
| rxa01381 | 944 | GB_PL1:AB005237 | AB005237 | *Arabidopsis thaliana* genomic DNA, chromosome 5, P1 clone: MJJ3, complete sequence. | *Arabidopsis thaliana* | 36,606 | 20 Nov. 1999 |
| | | GB_GSS5:AQ766840 | AQ766840 | HS_2026_A2_C09_T7C CIT Approved Human Genomic Sperm Library D *Homo sapiens* genomic clone Plate = 2026 Col = 18 Row = E, genomic survey sequence. | *Homo sapiens* | 37,916 | 28 Jul. 1999 |
| rxa01393 | 993 | GB_BA1:MTV043 | AL022004 | *Mycobacterium tuberculosis* H37Rv complete genome; segment 40/162. | *Mycobacterium tuberculosis* | 37,419 | 24 Jun. 1999 |
| | | GB_BA1:CGLYSEG | X96471 | *C. glutamicum* lysE and lysG genes. | *Corynebacterium glutamicum* | 34,831 | 24 Feb. 1997 |
| | | GB_BA1:SC5A7 | AL031107 | *Streptomyces coelicolor* cosmid 5A7. | *Streptomyces coelicolor* | 35,138 | 27 Jul. 1998 |
| rxa01394 | 822 | GB_PR3:AC004054 | AC004054 | *Homo sapiens* chromosome 4 clone B220G8 map 4q21, complete sequence. | *Homo sapiens* | 37,277 | 9 Jul. 1998 |
| | | GB_BA1:CGLYSEG | X96471 | *C. glutamicum* lysE and lysG genes. | *Corynebacterium glutamicum* | 100,000 | 24 Feb. 1997 |
| | | GB_GSS5:AQ769223 | AQ769223 | HS_3155_B2_G10_T7C CIT Approved Human Genomic Sperm Library D *Homo sapiens* genomic clone Plate = 3155 Col = 20 Row = N, genomic survey sequence. | *Homo sapiens* | 38,400 | 28 Jul. 1999 |
| rxa01416 | 630 | GB_BA1:CGLYSEG | X96471 | *C. glutamicum* lysE and lysG genes. | *Corynebacterium glutamicum* | 33,665 | 24 Feb. 1997 |
| | | GB_BA1:SC3C3 | AL031231 | *Streptomyces coelicolor* cosmid 3C3. | *Streptomyces coelicolor* | 62,726 | 10 Aug. 1998 |
| | | GB_BA1:MLCB22 | Z98741 | *Mycobacterium leprae* cosmid B22. | *Mycobacterium leprae* | 39,159 | 22 Aug. 1997 |
| rxa01442 | 1347 | GB_BA1:MTV002 | AL008967 | *Mycobacterium tuberculosis* H37Rv complete genome; segment 122/162. | *Mycobacterium tuberculosis* | 37,340 | 17 Jun. 1998 |
| | | GB_BA1:D90827 | D90827 | *E. coli* genomic DNA, Kohara clone #336(41.2-41.6 min.). | *Escherichia coli* | 58,517 | 21 Mar. 1997 |
| | | GB_BA1:D90828 | D90828 | *E. coli* genomic DNA, Kohara clone #336gap(41.6-41.9 min.). | *Escherichia coli* | 56,151 | 21 Mar. 1997 |
| | | GB_BA2:AE000279 | AE000279 | *Escherichia coli* K-12 MG1655 section 169 of 400 of the complete genome. | *Escherichia coli* | 56,021 | 12 Nov. 1998 |
| rxa01446 | 1413 | GB_BA1:SCH10 | AL049754 | *Streptomyces coelicolor* cosmid H10. | *Streptomyces coelicolor* | 39,037 | 04 May 1999 |
| | | GB_BA1:MTY13E10 | Z95324 | *Mycobacterium tuberculosis* H37Rv complete genome; segment 18/162. | *Mycobacterium tuberculosis* | 40,130 | 17 Jun. 1998 |
| | | GB_BA1:MLCB4 | AL023514 | *Mycobacterium leprae* cosmid B4. | *Mycobacterium leprae* | 37,752 | 27 Aug. 1999 |
| rxa01483 | 1395 | GB_BA1:MTCY98 | Z83860 | *Mycobacterium tuberculosis* H37Rv complete genome; segment 103/162. | *Mycobacterium tuberculosis* | 39,057 | 17 Jun. 1998 |
| | | GB_BA1:MSGB1229CS | L78812 | *Mycobacterium leprae* cosmid B1229 DNA sequence. | *Mycobacterium leprae* | 54,382 | 15 Jun. 1996 |
| | | GB_BA2:AF027507 | AF027507 | *Mycobacterium smegmatis* dGTPase (dgt), and primase (dnaG) genes, complete cds; tRNA-Asn gene, complete sequence. | *Mycobacterium smegmatis* | 52,941 | 16 Jan. 1998 |
| rxa01486 | 757 | GB_BA1:MTV002 | AL008967 | *Mycobacterium tuberculosis* H37Rv complete genome; segment 122/162. | *Mycobacterium tuberculosis* | 40,941 | 17 Jun. 1998 |
| | | GB_BA1:MLCB22 | Z98741 | *Mycobacterium leprae* cosmid B22. | *Mycobacterium leprae* | 38,451 | 22 Aug. 1997 |
| | | GB_BA1:SC3C3 | AL031231 | *Streptomyces coelicolor* cosmid 3C3. | *Streptomyces coelicolor* | 61,194 | 10 Aug. 1998 |
| rxa01489 | 1146 | GB_BA1:CORFADS | D37967 | *Corynebacterium ammoniagenes* gene for FAD synthetase, complete cds. | *Corynebacterium ammoniagenes* | 58,021 | 8 Feb. 1999 |
| rxa01491 | 774 | GB_BA1:MLCB22 | Z98741 | *Mycobacterium leprae* cosmid B22. | *Mycobacterium leprae* | 38,414 | 22 Aug. 1997 |
| | | GB_BA1:SC10A7 | AL078618 | *Streptomyces coelicolor* cosmid 10A7. | *Streptomyces coelicolor* | 36,930 | 9 Jun. 1999 |
| | | GB_BA1:MTV002 | AL008967 | *Mycobacterium tuberculosis* H37Rv complete genome; segment 122/162. | *Mycobacterium tuberculosis* | 37,062 | 17 Jun. 1998 |
| | | GB_EST13:AA356956 | AA356956 | EST65614 Jurkat T-cells III *Homo sapiens* cDNA 5' end, mRNA sequence. | *Homo sapiens* | 37,647 | 21 Apr. 1997 |
| | | GB_OV:OMDNAPROI | X92380 | *O. mossambicus* prolactin I gene. | *Tilapia mossambica* | 38,289 | 19 Oct. 1995 |
| rxa01508 | 1662 | GB_IN1:CEF28C12 | Z93380 | *Caenorhabditis elegans* cosmid F28C12, complete sequence. | *Caenorhabditis elegans* | 37,984 | 23 Nov. 1998 |
| | | GB_IN1:CEF28C12 | Z93380 | *Caenorhabditis elegans* cosmid F28C12, complete sequence. | *Caenorhabditis elegans* | 38,469 | 23 Nov. 1998 |
| rxa01512 | 723 | GB_BA1:SCE9 | AL049841 | *Streptomyces coelicolor* cosmid E9. | *Streptomyces coelicolor* | 39,021 | 19 May 1999 |
| | | GB_BA1:MAU88875 | U88875 | *Mycobacterium avium* hypoxanthine-guanine phosphoribosyl transferase gene, complete cds. | *Mycobacterium avium* | 57,521 | 05 Mar. 1997 |
| rxa01514 | 711 | GB_BA1:MTY15C10 | Z95436 | *Mycobacterium tuberculosis* H37Rv complete genome; segment 154/162. | *Mycobacterium tuberculosis* | 40,086 | 17 Jun. 1998 |
| | | GB_BA1:MTCY7H7B | Z95557 | *Mycobacterium tuberculosis* H37Rv complete genome; segment 153/162. | *Mycobacterium tuberculosis* | 43,343 | 18 Jun. 1998 |
| | | GB_BA1:MLCB2548 | AL023093 | *Mycobacterium leprae* cosmid B2548. | *Mycobacterium leprae* | 38,177 | 27 Aug. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01515 | 975 | GB_PL1:EGGTPCHI | 242 | Z49757 | E. gracilis mRNA for GTP cyclohydrolase I (core region). | Euglena gracilis | 64.876 | 20 Oct. 1995 |
| | | GB_BA1:ECOUW93 | 338534 | U14003 | Escherichia coli K-12 chromosomal region from 92.8 to 00.1 minutes. | Escherichia coli | 38.943 | 17 Apr. 1996 |
| | | GB_BA1:ECOUW93 | 338534 | U14003 | Escherichia coli K-12 chromosomal region from 92.8 to 00.1 minutes. | Escherichia coli | 37.500 | 17 Apr. 1996 |
| | | GB_BA1:MTCY49 | 39430 | Z73966 | Mycobacterium tuberculosis H37Rv complete genome; segment 93/162. | Mycobacterium tuberculosis | 38.010 | 24 Jun. 1999 |
| rxa01516 | 513 | GB_IN1:DME238847 | 5419 | AJ238847 | Drosophila melanogaster mRNA for drosophila dodeca-satellite protein 1 (DDP-1). | Drosophila melanogaster | 36.346 | 13 Aug. 1999 |
| | | GB_HTG3:AC009210 | 103814 | AC009210 | Drosophila melanogaster chromosome 2 clone BACR01106 (D1054) RPCI-98 011.6 map 55D-55D strain y; cn bw sp, *SEQUENCING IN PROGRESS*, 86 unordered pieces. | Drosophila melanogaster | 37.897 | 20 Aug. 1999 |
| rxa01517 | 600 | GB_IN2:AF132179 | 4842 | AF132179 | Drosophila melanogaster clone LD21677 unknown mRNA. | Drosophila melanogaster | 36.149 | 3 Jun. 1999 |
| | | GB_PL2:F6H8 | 82596 | AF178045 | Arabidopsis thaliana BAC F6H8. | Arabidopsis thaliana | 35.846 | 19 Aug. 1999 |
| | | GB_PL2:AF038831 | 647 | AF038831 | Sorosporium saponariae internal transcribed spacer 1, 5.8S ribosomal RNA gene; and internal transcribed spacer 2, complete sequence. | Sorosporium saponariae | 40.566 | 13 Apr. 1999 |
| | | GB_PL2:ATAC005957 | 108355 | AC005957 | Arabidopsis thaliana chromosome II BAC T15J14 genomic sequence, complete sequence. | Arabidopsis thaliana | 38.095 | 7 Jan. 1999 |
| rxa01521 | 921 | GB_BA1:ANANIFBH | 5936 | J05111 | Anabaena sp. (clone AnH20.1) nitrogen fixation operon nifB, fdxN, nifS, nifU, and nifH genes, complete cds. | Anabaena sp. | 38.206 | 26 Apr. 1993 |
| | | GB_PR2:AC002461 | 197273 | AC002461 | Human BAC clone RG204I16 from 7q31, complete sequence. | Homo sapiens | 36.623 | 20 Aug. 1997 |
| | | GB_PR2:AC002461 | 197273 | AC002461 | Human BAC clone RG204I16 from 7q31, complete sequence. | Homo sapiens | 34.719 | 20 Aug. 1997 |
| rxa01528 | 651 | GB_RO:MM437P9 | 165901 | AL049866 | Mus musculus chromosome X, clone 437P9. | Mus musculus | 37.500 | 29 Jun. 1999 |
| | | GB_PR3:AC005740 | 186780 | AC005740 | Homo sapiens chromosome 5p, BAC clone 50g21 (LBNL H154), complete sequence. | Homo sapiens | 37.031 | 01 Oct. 1998 |
| | | GB_PR3:AC005740 | 186780 | AC005740 | Homo sapiens chromosome 5p, BAC clone 50g21 (LBNL H154), complete sequence. | Homo sapiens | 38.035 | 01 Oct. 1998 |
| rxa01551 | 1998 | GB_BA1:MTCY22G10 | 35420 | Z84724 | Mycobacterium tuberculosis H37Rv complete genome; segment 21/162. | Mycobacterium tuberculosis | 38.371 | 17 Jun. 1998 |
| | | GB_BA2:ECOUW89 | 176195 | U00006 | E. coli chromosomal region from 89.2 to 92.8 minutes. | Escherichia coli | 38.064 | 17 Dec. 1993 |
| | | GB_BA1:SCQ11 | 15441 | AL096823 | Streptomyces coelicolor cosmid Q11. | Streptomyces coelicolor | 60.775 | 8 Jul. 1999 |
| rxa01561 | 1053 | GB_IN1:CEY62H9A | 47396 | AL032630 | Caenorhabditis elegans cosmid Y62H9A, complete sequence. | Caenorhabditis elegans | 38.514 | 2 Sep. 1999 |
| | | GB_PR4:HSU51003 | 3202 | U51003 | Homo sapiens DLX-2 (DLX-2) gene, complete cds. | Homo sapiens | 37.730 | 07 Dec. 1999 |
| | | GB_OM:PIGDAO1 | 395 | M18444 | Pig D-amino acid oxidase (DAO) gene, exon 1. | Sus scrofa | 39.340 | 27 Apr. 1993 |
| rxa01599 | 1785 | GB_BA1:MTCI125 | 37432 | Z98268 | Mycobacterium tuberculosis H37Rv complete genome; segment 76/162. | Mycobacterium tuberculosis | 63.300 | 17 Jun. 1998 |
| | | GB_BA1:U00021 | 39193 | U00021 | Mycobacterium leprae cosmid L247. | Mycobacterium leprae | 36.756 | 29 Sep. 1994 |
| | | GB_BA1:MLCB1351 | 38936 | Z95117 | Mycobacterium leprae cosmid B1351. | Mycobacterium leprae | 36.756 | 24 Jun. 1997 |
| rxa01617 | 795 | GB_PR2:HSMTM0 | 217657 | AL034384 | Human chromosome Xq28, cosmid clones 7H3, 14D7, C1230, 11E7, F1096, A12197, 12G8, A09100; complete sequence bases 1 . . . 217657. | Homo sapiens | 40.811 | 5 Jul. 1999 |
| | | GB_PR2:HS13D10 | 153147 | AL021407 | Homo sapiens DNA sequence from PAC 13D10 on chromosome 6p22.3-23. Contains CpG island. | Homo sapiens | 38.768 | 23 Nov. 1999 |
| | | GB_PR2:HSMTM0 | 217657 | AL034384 | Human chromosome Xq28, cosmid clones 7H3, 14D7, C1230, 11E7, F1096, A12197, 12G8, A09100; complete sequence bases 1 . . . 217657. | Homo sapiens | 39.018 | 5 Jul. 1999 |
| rxa01657 | 723 | GB_BA1:MTCY1A10 | 25949 | Z95387 | Mycobacterium tuberculosis H37Rv complete genome; segment 117/162. | Mycobacterium tuberculosis | 40.656 | 17 Jun. 1998 |
| | | GB_EST6:D79278 | 392 | D79278 | HUM213D06B Human aorta polyA+ (TFujiwara) Homo sapiens cDNA clone GEN-213D06 5', mRNA sequence. | Homo sapiens | 44.262 | 9 Feb. 1996 |
| rxa01660 | 675 | GB_BA2:AF129925 | 10243 | AF129925 | Thiobacillus ferrooxidans carboxysome operon, complete cds. | Thiobacillus ferrooxidans | 40.709 | 17 May 1999 |
| | | GB_BA1:MTV013 | 11364 | AL021309 | Mycobacterium tuberculosis H37Rv complete genome; segment 134/162. | Mycobacterium tuberculosis | 40.986 | 17 Jun. 1998 |
| | | GB_RO:MMFV1 | 6480 | X97719 | M. musculus retrovirus restriction gene Fv1. | Mus musculus | 35.364 | 29 Aug. 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01678 | 651 | GB_PAT:A67508 | 6480 | A67508 | Sequence 1 from Patent WO9743410. | Mus musculus | 35,364 | 05 May 1999 |
| | | GB_VI:TVU95309 | 600 | U95309 | Tula virus O64 nucleocapsid protein gene, partial cds. | Tula virus | 41,894 | 28 Oct. 1997 |
| | | GB_VI:TVU95303 | 600 | U95303 | Tula virus O52 nucleocapsid protein gene, partial cds. | Tula virus | 41,712 | 28 Oct. 1997 |
| | | GB_VI:TVU95302 | 600 | U95302 | Tula virus O24 nucleocapsid protein gene, partial cds. | Tula virus | 39,576 | 28 Oct. 1997 |
| rxa01679 | 1359 | GB_EST5:H91843 | 362 | H91843 | ys81e01.s1 Soares retina N2b4HR Homo sapiens cDNA clone IMAGE: 221208 3' similar to gb: X63749 _ma1 GUANINE NUCLEOTIDE-BINDING PROTEIN G(T), ALPHA-1 (HUMAN); mRNA sequence. | Homo sapiens | 39,157 | 29 Nov. 1995 |
| | | GB_STS:G26925 | 362 | G26925 | human STS SHGC-30023, sequence tagged site. | Homo sapiens | 39,157 | 14 Jun. 1996 |
| | | GB_PL2:AF139451 | 1202 | AF139451 | Gossypium robinsonii CeIA2 pseudogene, partial sequence. | Gossypium robinsonii | 38,910 | 1 Jun. 1999 |
| rxa01690 | 1224 | GB_BA1:SC1C2 | 42210 | AL031124 | Streptomyces coelicolor cosmid 1C2. | Streptomyces coelicolor | 60,644 | 15 Jan. 1999 |
| | | GB_EST22:AI064232 | 493 | AI064232 | GH04563.5prime GH Drosophila melanogaster head pOT2 Drosophila melanogaster cDNA clone GH04563 5prime, mRNA sequence. | Drosophila melanogaster | 38,037 | 24 Nov. 1998 |
| rxa01692 | 873 | GB_IN2:AF117896 | 1020 | AF117896 | Drosophila melanogaster neuropeptide F (npf) gene, complete cds. | Drosophila melanogaster | 36,122 | 2 Jul. 1999 |
| | | GB_BA2:AF067123 | 1034 | AF067123 | Lactobacillus reuteri cobalamin biosynthesis protein J (cbiJ) gene, partial cds; and uroporphyrin-III C-methyltransferase (sumT) gene, complete cds. | Lactobacillus reuteri | 48,079 | 3 Jun. 1998 |
| | | GB_RO:RATNFHPEP | 3085 | M37227 | Rat heavy neurofilament (NF-H) polypeptide, NF-H C-terminus. | Rattus norvegicus | 37,093 | 27 Apr. 1993 |
| | | GB_RO:RSNFH | 3085 | X13804 | Rat mRNA for heavy neurofilament polypeptide NF-H C-terminus. | Rattus sp. | 37,093 | 14 Jul. 1995 |
| rxa01698 | 1353 | GB_BA2:AF124600 | 4115 | AF124600 | Corynebacterium glutamicum chorismate synthase (aroC), shikimate kinase (aroK), and 3-dehydroquinate synthase (aroB) genes, complete cds; and putative cytoplasmic peptidase (pepQ) gene, partial cds. | Corynebacterium glutamicum | 100,000 | 04 May 1999 |
| | | GB_BA1:MTCY159 | 33818 | Z83863 | Mycobacterium tuberculosis H37Rv complete genome; segment 111/162. | Mycobacterium tuberculosis | 36,323 | 17 Jun. 1998 |
| | | GB_BA1:MSGB937CS | 38914 | L78820 | Mycobacterium leprae cosmid B937 DNA sequence. | Mycobacterium leprae | 62,780 | 15 Jun. 1996 |
| rxa01699 | 693 | GB_BA2:AF124600 | 4115 | AF124600 | Corynebacterium glutamicum chorismate synthase (aroC), shikimate kinase (aroK), and 3-dehydroquinate synthase (aroB) genes, complete cds; and putative cytoplasmic peptidase (pepQ) gene, partial cds. | Corynebacterium glutamicum | 100,000 | 04 May 1999 |
| | | GB_BA2:AF016585 | 41097 | AF016585 | Streptomyces caelestis cytochrome P-450 hydroxylase homolog (midi) gene, partial cds; polyketide synthase modules 1 through 7 (midA) genes, complete cds; and N-methyltransferase homolog gene, partial cds. | Streptomyces caelestis | 40,260 | 07 Dec. 1997 |
| | | GB_EST9:C19712 | 399 | C19712 | C19712 Rice panicle at ripening stage Oryza sativa cDNA clone E10821_1A, mRNA sequence. | Oryza sativa | 45,425 | 24 Oct. 1996 |
| rxa01712 | 805 | GB_EST21:AA952466 | 278 | AA952466 | TENS1404 T. cruzi epimastigote normalized cDNA Library Trypanosoma cruzi cDNA clone 1404 5', mRNA sequence. | Trypanosoma cruzi | 40,876 | 29 Oct. 1998 |
| | | GB_EST21:AA952466 | 278 | AA952466 | TENS1404 T. cruzi epimastigote normalized cDNA Library Trypanosoma cruzi cDNA clone 1404 5', mRNA sequence. | Trypanosoma cruzi | 41,367 | 29 Oct. 1998 |
| rxa01719 | 684 | GB_HTG1:HSDJ534K7 | 154416 | AL109925 | Homo sapiens chromosome 1 clone RP4-534K7, *SEQUENCING IN PROGRESS*, in unordered pieces. | Homo sapiens | 35,651 | 23 Nov. 1999 |
| | | GB_HTG1:HSDJ534K7 | 154416 | AL109925 | Homo sapiens chromosome 1 clone RP4-534K7, *SEQUENCING IN PROGRESS*, in unordered pieces. | Homo sapiens | 35,651 | 23 Nov. 1999 |
| | | GB_EST27:AI447108 | 431 | AI447108 | mq91e08.x1 Stratagene mouse heart (#937316) Mus musculus cDNA clone IMAGE: 586118 3', mRNA sequence. | Mus musculus | 39,671 | 09 Mar. 1999 |
| rxa01720 | 1332 | GB_PR4:AC006322 | 179640 | AC006322 | Homo sapiens PAC clone DJ1060B11 from 7q11.23-q21.1, complete sequence. | Homo sapiens | 35,817 | 18 Mar. 1999 |
| | | GB_PL2:TM018A10 | 106184 | AF013294 | Arabidopsis thaliana BAC TM018A10. | Arabidopsis thaliana | 35,698 | 12 Jul. 1997 |
| | | GB_PR4:AC006322 | 179640 | AC006322 | Homo sapiens PAC clone DJ1060B11 from 7q11.23-q21.1, complete sequence. | Homo sapiens | 37,243 | 18 Mar. 1999 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
| rxa01746 | 876 | GB_EST3:R46227 | R46227 | yg52a03.s1 Soares infant brain 1NIB Homo sapiens cDNA clone IMAGE: 36000 3', mRNA sequence. | Homo sapiens | 42,812 | 22 May 1995 |
| | | GB_EST3:R46227 | R46227 | yg52a03.s1 Soares infant brain 1NIB Homo sapiens cDNA clone IMAGE: 36000 3', mRNA sequence. | Homo sapiens | 42,655 | 22 May 1995 |
| rxa01747 | 1167 | GB_BA1:MTCY190 | Z70283 | Mycobacterium tuberculosis H37Rv complete genome; segment 98/162. | Mycobacterium tuberculosis | 59,294 | 17 Jun. 1998 |
| | | GB_BA1:MLCB22 | Z98741 | Mycobacterium leprae cosmid B22. | Mycobacterium leprae | 57,584 | 22 Aug. 1997 |
| | | GB_BA1:SC5F7 | AL096872 | Streptomyces coelicolor cosmid 5F7. | Streptomyces coelicolor A3(2) | 61,810 | 22 Jul. 1999 |
| rxa01757 | 924 | GB_EST21:AA918454 | AA918454 | om38o02.s1 Soares_NFL_T_GBC_S1 Homo sapiens cDNA clone IMAGE: 1543298 3' similar to WP: F28F8.3 CE09757 SMALL NUCLEAR RIBONUCLEOPROTEIN E;, mRNA sequence. | Homo sapiens | 39,655 | 23 Jun. 1998 |
| rxa01807 | 915 | GB_EST4:H34042 | H34042 | EST110563 Rat PC-12 cells, NGF-treated (9 days) Rattus sp. cDNA clone RPNBI81 5' end, mRNA sequence. | Rattus sp. | 35,942 | 2 Apr. 1998 |
| | | GB_EST20:AA899038 | AA899038 | NCP6G8T7 Perithecial Neurospora crassa cDNA clone NP6G8 3' end, mRNA sequence. | Neurospora crassa | 40,000 | 12 Apr. 1998 |
| | | GB_BA1:AP000063 | AP000063 | Aeropyrum pernix genomic DNA, section 6/7. | Aeropyrum pernix | 40,067 | 22 Jun. 1999 |
| | | GB_HTG4:AC010694 | AC010694 | Drosophila melanogaster clone RPCI98-6H2, *SEQUENCING IN PROGRESS*, 75 unordered pieces. | Drosophila melanogaster | 35,450 | 16 Oct. 1999 |
| rxa01821 | 401 | GB_HTG4:AC010694 | AC010694 | Drosophila melanogaster clone RPCI98-6H2, *SEQUENCING IN PROGRESS*, 75 unordered pieces. | Drosophila melanogaster | 35,450 | 16 Oct. 1999 |
| | | GB_BA1:CGL007732 | AJ007732 | Corynebacterium glutamicum 3' ppc gene, secG gene, amt gene, ocd gene and 5' soxA gene. | Corynebacterium glutamicum | 100,000 | 7 Jan. 1999 |
| rxa01835 | 654 | GB_RO:RATALGL | M24108 | Rattus norvegicus (clone A2U42) alpha2u globulin gene, exons 1-7. | Rattus norvegicus | 38,692 | 15 Dec. 1994 |
| | | GB_OV:APIGY2 | X78272 | Anas platyrhynchos (Super M) IgY upsilon heavy chain gene, exon 2. | Anas platyrhynchos | 36,962 | 15 Feb. 1999 |
| | | GB_EST30:AI629479 | AI629479 | 486101D10.x1 486 - leaf primordia cDNA library from Hake lab Zea mays cDNA, mRNA sequence. | Zea mays | 38,109 | 26 Apr. 1999 |
| rxa01850 | 1470 | GB_STS:G48245 | G48245 | SHGC-62915 Human Homo sapiens STS genomic, sequence tagged site. | Homo sapiens | 37,021 | 26 Mar. 1999 |
| | | GB_GSS3:B49052 | B49052 | RPCI11-4I12.TV RPCI-11 Homo sapiens genomic clone RPCI-11-4I12, genomic survey sequence. | Homo sapiens | 37,021 | 8 Apr. 1999 |
| | | GB_BA2:ECOUW67_0 | U18997 | Escherichia coli K-12 chromosomal region from 67.4 to 76.0 minutes. | Escherichia coli | 37,196 | U18997 |
| | | GB_BA2:AE000392 | AE000392 | Escherichia coli K-12 MG1655 section 282 of 400 of the complete genome. | Escherichia coli | 38,021 | 12 Nov. 1998 |
| | | GB_BA2:U32715 | U32715 | Haemophilus influenzae Rd section 30 of 163 of the complete genome. | Haemophilus influenzae Rd | 39,860 | 29 May 1998 |
| rxa01878 | 1002 | GB_HTG1:CEY64F11 | Z99776 | Caenorhabditis elegans chromosome IV clone Y64F11, **SEQUENCING IN PROGRESS*, in unordered pieces. | Caenorhabditis elegans | 37,564 | 14 Oct. 1998 |
| | | GB_HTG1:CEY64F11 | Z99776 | Caenorhabditis elegans chromosome IV clone Y64F11, **SEQUENCING IN PROGRESS*, in unordered pieces. | Caenorhabditis elegans | 37,564 | 14 Oct. 1998 |
| | | GB_HTG1:CEY64F11 | Z99776 | Caenorhabditis elegans chromosome IV clone Y64F11, **SEQUENCING IN PROGRESS*, in unordered pieces. | Caenorhabditis elegans | 37,576 | 14 Oct. 1998 |
| rxa01892 | 852 | GB_BA1:MTCY274 | Z74024 | Mycobacterium tuberculosis H37Rv complete genome; segment 126/162. | Mycobacterium tuberculosis | 35,910 | 19 Jun. 1998 |
| | | GB_BA1:MLCB250 | Z97369 | Mycobacterium leprae cosmid B250. | Mycobacterium leprae | 64,260 | 27 Aug. 1999 |
| | | GB_BA1:MSGB1529CS | L78824 | Mycobacterium tuberculosis cosmid B1529 DNA sequence. | Mycobacterium tuberculosis | 64,260 | 15 Jun. 1996 |
| rxa01894 | 978 | GB_BA1:MTCY274 | Z74024 | Mycobacterium tuberculosis H37Rv complete genome; segment 126/162. | Mycobacterium tuberculosis | 37,229 | 19 Jun. 1998 |
| | | GB_IN1:CELF46H5 | U41543 | Caenorhabditis elegans cosmid F46H5. | Caenorhabditis elegans | 38,525 | 29 Nov. 1996 |
| | | GB_HTG3:AC009204 | AC009204 | Drosophila melanogaster chromosome 2 clone BACR03E19 (D1033) RPCI-98 03.E.19 map 36E-37C strain y; cn bw sp, *SEQUENCING IN PROGRESS*, 94 unordered pieces. | Drosophila melanogaster | 31,579 | 18 Aug. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01920 | 1125 | GB_BA2:AF112536 | 1798 | AF112536 | Corynebacterium glutamicum ribonucleotide reductase beta-chain (nrdF) gene, complete cds. | Corynebacterium glutamicum | 99,733 | 5 Aug. 1999 |
| | | GB_BA1:CANRDFGEN | 6054 | Y09572 | Corynebacterium ammoniagenes nrdH, nrdI, nrdE, nrdF genes. | Corynebacterium ammoniagenes | 70,321 | 18 Apr. 1998 |
| | | GB_BA2:AF050168 | 1228 | AF050168 | Corynebacterium ammoniagenes ribonucleoside diphosphate reductase small subunit (nrdF) gene, complete cds. | Corynebacterium ammoniagenes | 72,082 | 23 Apr. 1998 |
| rxa01928 | 960 | GB_BA1:CGPAN | 2164 | X96580 | C. glutamicum panB, panC & xylB genes. | Corynebacterium glutamicum | 100,000 | 11 May 1999 |
| | | GB_PL1:AP000423 | 154478 | AP000423 | Arabidopsis thaliana chloroplast genomic DNA, complete sequence, strain: Columbia. | Chloroplast Arabidopsis thaliana | 35,917 | 15 Sep. 1999 |
| | | GB_PL1:AP000423 | 154478 | AP000423 | Arabidopsis thaliana chloroplast genomic DNA, complete sequence, strain: Columbia. | Chloroplast Arabidopsis thaliana | 33,925 | 15 Sep. 1999 |
| rxa01929 | 936 | GB_BA1:CGPAN | 2164 | X96580 | C. glutamicum panB, panC & xylB genes. | Corynebacterium glutamicum | 100,000 | 11 May 1999 |
| | | GB_BA1:XCU33548 | 8429 | U33548 | Xanthomonas campestris hrpB pathogenicity locus proteins HrpB1, HrpB2, HrpB3, HrpB4, HrpB5, HrpB6, HrpB7, HrpB8, HrpA1, and ORF62 genes, complete cds. | Xanthomonas campestris pv. vesicatoria | 38,749 | 19 Sep. 1996 |
| rxa01940 | 1059 | GB_BA1:XANHRPB6A | 1329 | M99174 | Xanthomonas campestris hrpB6 gene, complete cds. | Xanthomonas campestris | 39,305 | 14 Sep. 1993 |
| | | GB_IN2:CFU43371 | 1060 | U43371 | Crithidia fasciculata inosine-uridine preferring nucleoside hydrolase (IUNH) gene, complete cds. | Crithidia fasciculata | 61,417 | 18 Jun. 1996 |
| rxa02022 | 1230 | GB_BA2:AE001467 | 11601 | AE001467 | Helicobacter pylori, strain J99 section 28 of 132 of the complete genome. | Helicobacter pylori J99 | 38,560 | 20 Jan. 1999 |
| | | GB_RO:AF175967 | 3492 | AF175967 | Homo sapiens Leman coiled-coil protein (LCCP) mRNA, complete cds. | Mus musculus | 40,275 | 26 Sep. 1999 |
| | | GB_BA1:CGDAPE | 1966 | X81379 | C. glutamicum dapE gene and orf2. | Corynebacterium glutamicum | 100,000 | 8 Aug. 1995 |
| | | GB_BA1:CGDNAAROP | 2612 | X85965 | C. glutamicum ORF3 and aroP gene. | Corynebacterium glutamicum | 38,889 | 30 Nov. 1997 |
| | | GB_BA1:APU47055 | 6469 | U47055 | Anabaena PCC7120 nitrogen fixation proteins (nifE, nifN, nifX, nifW) genes, complete cds, and nitrogenase (nifK) and hesA genes, partial cds. | Anabaena PCC7120 | 36,647 | 17 Feb. 1996 |
| rxa02024 | 859 | GB_BA1:MTCI364 | 29540 | Z93777 | Mycobacterium tuberculosis H37Rv complete genome; segment 52/162. | Mycobacterium tuberculosis | 59,415 | 17 Jun. 1998 |
| | | GB_BA1:MSGB1912CS | 38503 | L01536 | M. leprae genomic dna sequence, cosmid b1912. | Mycobacterium leprae | 57,093 | 14 Jun. 1996 |
| | | GB_BA1:MLU15180 | 38675 | U15180 | Mycobacterium leprae cosmid B1756. | Mycobacterium leprae | 57,210 | 09 Mar. 1995 |
| rxa02027 | | | | | | | | |
| rxa02031 | | | | | | | | |
| rxa02072 | 1464 | GB_BA1:CGGDHA | 2037 | X72855 | C. glutamicum GDHA gene. | Corynebacterium glutamicum | 99,317 | 24 May 1993 |
| | | GB_BA1:CGGDH | 2037 | X59404 | Corynebacterium glutamicum, gdh gen for glutamate dehydrogenase. | Corynebacterium glutamicum | 94,387 | 30 Jul. 1999 |
| | | GB_BA1:PAEI8494 | 1628 | Y18494 | Pseudomonas aeruginosa gdhA gene, strain PAC1. | Pseudomonas aeruginosa | 62,247 | 6 Feb. 1999 |
| rxa02085 | 2358 | GB_BA1:MTCY22G8 | 22550 | Z95585 | Mycobacterium tuberculosis H37Rv complete genome; segment 49/162. | Mycobacterium tuberculosis | 38,442 | 17 Jun. 1998 |
| | | GB_BA1:MLCB33 | 42224 | Z94723 | Mycobacterium leprae cosmid B33. | Mycobacterium leprae | 56,486 | 24 Jun. 1997 |
| | | GB_BA1:ECOUW85 | 91414 | M87049 | E. coli genomic sequence of the region from 84.5 to 86.5 minutes. | Escherichia coli | 52,127 | 29 May 1995 |
| rxa02093 | 927 | GB_EST14:AA448146 | 452 | AA448146 | zw82h01.r1 Soares_testis_NHT Homo sapiens cDNA clone IMAGE: 782737 5′, mRNA sequence. | Homo sapiens | 34,163 | 4 Jun. 1997 |
| | | GB_EST17:AA641937 | 444 | AA641937 | ns18b10.r1 NCI_CGAP_GCB1 Homo sapiens cDNA clone IMAGE: 1183963 5′, mRNA sequence. | Homo sapiens | 35,586 | 27 Oct. 1997 |
| rxa02106 | 1179 | GB_PR3:AC003074 | 143029 | AC003074 | Human PAC clone DJ0596O09 from 7p15, complete sequence. | Homo sapiens | 31,917 | 6 Nov. 1997 |
| | | GB_BA1:SC1A6 | 37620 | AL023496 | Streptomyces coelicolor cosmid 1A6. | Streptomyces coelicolor | 35,818 | 13 Jan. 1999 |
| | | GB_PR4:AC005553 | 179651 | AC005553 | Homo sapiens chromosome 17, clone hRPK.112_J_9, complete sequence. | Homo sapiens | 34,274 | 31 Dec. 1998 |
| | | GB_EST3:R49746 | 397 | R49746 | yg71g10.r1 Soares infant brain 1NIB Homo sapiens cDNA clone IMAGE: 38768 5′ similar to gb: V00567 BETA-2-MICROGLOBULIN PRECURSOR (HUMAN); mRNA sequence. | Homo sapiens | 41,162 | 18 May 1995 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
| rxa02111 | 1407 | GB_BA1:SCGG10 | AL049497 | *Streptomyces coelicolor* cosmid 6G10. | *Streptomyces coelicolor* | 50,791 | 24 Mar. 1999 |
| | | GB_BA1:U00010 | U00010 | *Mycobacterium leprae* cosmid B1170. | *Mycobacterium leprae* | 37,563 | 01 Mar. 1994 |
| | | GB_BA1:MTCY336 | Z95586 | *Mycobacterium tuberculosis* H37Rv complete genome; segment 70/162. | *Mycobacterium tuberculosis* | 39,504 | 24 Jun. 1999 |
| rxa02112 | 960 | GB_HTG3:AC010579 | AC010579 | *Drosophila melanogaster* chromosome 3 clone BACR09D08 (D1101) RPCI-98 09.D.8 map 96F-96F strain y; cn bw sp, *SEQUENCING IN PROGRESS*, 121 unordered pieces. | *Drosophila melanogaster* | 37,909 | 24 Sep. 1999 |
| | | GB_GSS3:B09839 | B09839 | T12A12-Sp6 TAMU *Arabidopsis thaliana* genomic clone T12A12, genomic survey sequence. | *Arabidopsis thaliana* | 37,843 | 14 May 1997 |
| | | GB_HTG3:AC010579 | AC010579 | *Drosophila melanogaster* chromosome 3 clone BACR09D08 (D1101) RPCI-98 09.D.8 map 96F-96F strain y; cn bw sp, *SEQUENCING IN PROGRESS*, 121 unordered pieces. | *Drosophila melanogaster* | 37,909 | 24 Sep. 1999 |
| rxa02134 | 1044 | GB_BA1:SCSECYDNA | X83011 | *S. coelicolor* secY locus DNA. | *Streptomyces coelicolor* | 36,533 | 02 Mar. 1998 |
| | | GB_EST32:AI731596 | AI731596 | BNLGHi10185 Six-day Cotton fiber *Gossypium hirsutum* cDNA 5' similar to (AC004005) putative ribosomal protein L7 [*Arabidopsis thaliana*], mRNA sequence. | *Gossypium hirsutum* | 33,451 | 11 Jun. 1999 |
| rxa02135 | 1197 | GB_BA1:SCSECYDNA | X83011 | *S. coelicolor* secY locus DNA. | *Streptomyces coelicolor* | 36,756 | 02 Mar. 1998 |
| | | GB_PR3:HS525L6 | AL023807 | Human DNA sequence from clone RP3-525L6 on chromosome 6p22.3-23 Contains CA repeat, STSs, GSSs and a CpG Island, complete sequence. | *Homo sapiens* | 34,365 | 23 Nov. 1999 |
| rxa02136 | 645 | GB_PL2:ATF21P8 | AL022347 | *Arabidopsis thaliana* DNA chromosome 4, BAC clone F21P8 (ESSA project). | *Arabidopsis thaliana* | 34,325 | 9 Jun. 1999 |
| | | GB_PL2:U89959 | U89959 | *Arabidopsis thaliana* BAC T7J23, complete sequence. | *Arabidopsis thaliana* | 33,874 | 26 Jun. 1998 |
| | | GB_PL2:ATAC005819 | AC005819 | *Arabidopsis thaliana* chromosome II BAC T3A4 genomic sequence, complete sequence. | *Arabidopsis thaliana* | 34,123 | 3 Nov. 1998 |
| rxa02139 | 1962 | GB_PL2:F15K9 | AC005278 | *Arabidopsis thaliana* chromosome 1 BAC F15K9 sequence, complete sequence. | *Arabidopsis thaliana* | 31,260 | 7 Nov. 1998 |
| | | GB_PL2:U89959 | U89959 | *Arabidopsis thaliana* BAC T7J23, complete sequence. | *Arabidopsis thaliana* | 34,281 | 26 Jun. 1998 |
| | | GB_BA1:MTCY190 | Z70283 | *Mycobacterium tuberculosis* H37Rv complete genome; segment 98/162. | *Mycobacterium tuberculosis* | 62,904 | 17 Jun. 1998 |
| | | GB_BA1:MSGB1554CS | L78814 | *Mycobacterium leprae* cosmid B1554 DNA sequence. | *Mycobacterium leprae* | 36,648 | 15 Jun. 1996 |
| | | GB_BA1:MSGB1551CS | L78813 | *Mycobacterium leprae* cosmid B1551 DNA sequence. | *Mycobacterium leprae* | 36,648 | 15 Jun. 1996 |
| rxa02153 | 903 | GB_BA2:AF049897 | AF049897 | *Corynebacterium glutamicum* N-acetylglutamyl phosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 99,104 | 1 Jul. 1998 |
| rxa02154 | 1044 | GB_BA1:AF005242 | AF005242 | *Corynebacterium glutamicum* N-acetylglutamate-5-semialdehyde dehydrogenase (argC) gene, complete cds. | *Corynebacterium glutamicum* | 99,224 | 2 Jul. 1997 |
| | 414 | GB_BA1:CGARGCJBD | X86157 | *C. glutamicum* argC, argJ, argB, argD, and argF genes. | *Corynebacterium glutamicum* | 100,000 | 25 Jul. 1996 |
| | 9196 | GB_BA2:AF049897 | AF049897 | *Corynebacterium glutamicum* N-acetylglutamyl phosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 98,551 | 1 Jul. 1998 |
| rxa02155 | 1044 | GB_BA1:AF005242 | AF005242 | *Corynebacterium glutamicum* N-acetylglutamate-5-semialdehyde dehydrogenase (argC) gene, complete cds. | *Corynebacterium glutamicum* | 98,477 | 2 Jul. 1997 |
| | 4355 | GB_BA1:CGARGCJBD | X86157 | *C. glutamicum* argC, argJ, argB, argD, and argF genes. | *Corynebacterium glutamicum* | 100,000 | 25 Jul. 1996 |
| | 1287 | GB_BA1:CGARGCJBD | X86157 | *C. glutamicum* argC, argJ, argB, argD, and argF genes. | *Corynebacterium glutamicum* | 99,767 | 25 Jul. 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 99,378 | 1 Jul. 1998 |
| rxa02156 | 1074 | GB_BA1:MSGB1133CS | 42106 | L78811 | *Mycobacterium leprae* cosmid B1133 DNA sequence. | *Mycobacterium leprae* | 55,504 | 15 Jun. 1996 |
| | | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 100,000 | 1 Jul. 1998 |
| rxa02157 | 1296 | GB_BA1:CGARGCJBD | 4355 | X86157 | *C. glutamicum* argC, argI, argB, argD, and argF genes. | *Corynebacterium glutamicum* | 100,000 | 25 Jul. 1996 |
| | | GB_BA2:AE001816 | 10007 | AE001816 | *Thermotoga maritima* section 128 of 136 of the complete genome. | *Thermotoga maritima* | 50,238 | 2 Jun. 1999 |
| | | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 99,612 | 1 Jul. 1998 |
| rxa02158 | 1080 | GB_BA1:CGARGCJBD | 4355 | X86157 | *C. glutamicum* argC, argI, argB, argD, and argF genes. | *Corynebacterium glutamicum* | 99,612 | 25 Jul. 1996 |
| | | GB_BA1:MTCY06H11 | 38000 | Z85982 | *Mycobacterium tuberculosis* H37Rv complete genome; segment 73/162. | *Mycobacterium tuberculosis* | 57,278 | 17 Jun. 1998 |
| | | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 100,000 | 1 Jul. 1998 |
| rxa02159 | 636 | GB_BA2:AF031518 | 2045 | AF031518 | *Corynebacterium glutamicum* ornithine carbamoyltransferase (argF) gene, complete cds. | *Corynebacterium glutamicum* | 99,898 | 5 Jan. 1999 |
| | | GB_BA1:CGARGCJBD | 4355 | X86157 | *C. glutamicum* argC, argI, argB, argD, and argF genes. | *Corynebacterium glutamicum* | 100,000 | 25 Jul. 1996 |
| | | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 99,843 | 1 Jul. 1998 |
| rxa02160 | 1326 | GB_BA2:AF031518 | 2045 | AF031518 | *Corynebacterium glutamicum* ornithine carbamoyltransferase (argF) gene, complete cds. | *Corynebacterium glutamicum* | 88,679 | 5 Jan. 1999 |
| | | GB_BA2:AF041436 | 516 | AF041436 | *Corynebacterium glutamicum* arginine repressor (argR) gene, complete cds. | *Corynebacterium glutamicum* | 100,000 | 5 Jan. 1999 |
| | | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 99,774 | 1 Jul. 1998 |
| rxa02162 | 1554 | GB_BA2:AF030520 | 1206 | AF030520 | *Corynebacterium glutamicum* argininosuccinate synthetase (argG) gene, complete cds. | *Corynebacterium glutamicum* | 99,834 | 19 Nov. 1997 |
| | | GB_BA1:SCARGGH | 1909 | Z49111 | *S. clavuligerus* argG gene and argH gene (partial). | *Streptomyces clavuligerus* | 65,913 | 22 Apr. 1996 |
| | | GB_BA2:AF049897 | 9196 | AF049897 | *Corynebacterium glutamicum* N-acetylglutamylphosphate reductase (argC), | *Corynebacterium glutamicum* | 88,524 | 1 Jul. 1998 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
|  |  | GB_BA2:AF048764 | 1437 AF048764 | ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | Corynebacterium glutamicum | 87,561 | 1 Jul. 1998 |
| rxa02176 | 1251 | GB_BA1:MTCY06H11 | 38000 Z85982 | Corynebacterium glutamicum argininosuccinate lyase (argH) gene, complete cds. | Mycobacterium tuberculosis | 64,732 | 17 Jun. 1998 |
|  |  | GB_BA1:MTCY31 | 37630 Z73101 | Mycobacterium tuberculosis H37Rv complete genome; segment 73/162. | Mycobacterium tuberculosis | 36,998 | 17 Jun. 1998 |
|  |  | GB_BA1:CGGLTG | 3013 X66112 | Mycobacterium tuberculosis H37Rv complete genome; segment 41/162. | Corynebacterium glutamicum | 39,910 | 17 Feb. 1995 |
|  |  | GB_PL2:PGU65399 | 2700 U65399 | C. glutamicum glt gene for citrate synthase and ORF. | basidiomycete CECT 20197 | 38,474 | 19 Jul. 1997 |
| rxa02189 | 861 | GB_PR3:AC002468 | 115888 AC002468 | Basidiomycete CECT 20197 phenoloxidase (pox1) gene, complete cds. | Homo sapiens | 35,941 | 15 Sep. 1998 |
|  |  | GB_BA1:MSGB1970CS | 39399 L78815 | Human Chromosome 15q26.1 PAC clone pDJ417d7, complete sequence. | Mycobacterium leprae | 40,286 | 15 Jun. 1996 |
|  |  | GB_PR3:AC002468 | 115888 AC002468 | Mycobacterium leprae cosmid B1970 DNA sequence. | Homo sapiens | 33,689 | 16 Sep. 1998 |
| rxa02193 | 1701 | GB_BA1:BRLASPA | 1987 D25316 | Human Chromosome 15q26.1 PAC clone pDJ417d7, complete sequence. | Brevibacterium flavum | 99,353 | 6 Feb. 1999 |
|  |  | GB_PAT:E04307 | 1581 E04307 | Brevibacterium flavum aspA gene for aspartase, complete cds. | Corynebacterium glutamicum | 99,367 | 29 Sep. 1997 |
|  |  | GB_BA1:ECOUW93 | 338534 U14003 | DNA encoding Brevibacterium flavum aspartase. | Escherichia coli | 37,651 | 17 Apr. 1996 |
| rxa02194 | 966 | GB_BA2:AF050166 | 840 AF050166 | Escherichia coli K-12 chromosomal region from 92.8 to 00.1 minutes. | Corynebacterium glutamicum | 98,214 | 5 Jan. 1999 |
|  |  |  |  | Corynebacterium glutamicum ATP phosphoribosyltransferase (hisG) gene, complete cds. |  |  |  |
|  |  | GB_BA1:BRLASPA | 1987 D25316 | Brevibacterium flavum aspA gene for aspartase, complete cds. | Brevibacterium flavum | 93,805 | 6 Feb. 1999 |
|  |  | GB_PAT:E08649 | 188 E08649 | DNA encoding part of aspartase from coryneform bacteria. | Corynebacterium glutamicum | 100,000 | 29 Sep. 1997 |
| rxa02195 | 393 | GB_BA2:AF086704 | 264 AF086704 | Corynebacterium glutamicum phosphoribosyl-ATP-pyrophosphohydrolase (hisE) gene, complete cds. | Corynebacterium glutamicum | 100,000 | 8 Feb. 1999 |
|  |  | GB_BA1:EAY17145 | 6019 Y17145 | Eubacterium acidaminophilum grdR, grdL, grdH genes and partial Idc, grdT genes. | Eubacterium acidaminophilum | 39,075 | 5 Aug. 1998 |
| rxa02197 | 551 | GB_STS:G01195 | 332 G01195 | fruit fly STS Dm1930 clone DS06959 T7. | Drosophila melanogaster | 35,542 | 28 Feb. 1995 |
|  |  | GB_BA1:MTCY261 | 27322 Z97559 | Mycobacterium tuberculosis H37Rv complete genome; segment 95/162. | Mycobacterium tuberculosis | 33,938 | 17 Jun. 1998 |
|  |  | GB_BA1:MLCB2533 | 40245 AL035310 | Mycobacterium leprae cosmid B2533. | Mycobacterium leprae | 65,517 | 27 Aug. 1999 |
|  |  | GB_BA1:U00017 | 42157 U00017 | Mycobacterium leprae cosmid B2126. | Mycobacterium leprae | 36,770 | 01 Mar. 1994 |
| rxa02198 | 2599 | GB_BA1:U00017 | 42157 U00017 | Mycobacterium leprae cosmid B2126. | Mycobacterium leprae | 38,674 | 01 Mar. 1994 |
|  |  | GB_BA1:MLCB2533 | 40245 AL035310 | Mycobacterium leprae cosmid B2533. | Mycobacterium leprae | 65,465 | 27 Aug. 1999 |
|  |  | GB_BA1:MTCY261 | 27322 Z97559 | Mycobacterium tuberculosis H37Rv complete genome; segment 95/162. | Mycobacterium tuberculosis | 37,577 | 17 Jun. 1998 |
| rxa02208 | 1025 | GB_BA1:U00017 | 42157 U00017 | Mycobacterium leprae cosmid B2126. | Mycobacterium leprae | 59,823 | 01 Mar. 1994 |
|  |  | GB_BA1:AP000063 | 185300 AP000063 | Aeropyrum pernix genomic DNA, section 6/7. | Aeropyrum pernix | 39,442 | 22 Jun. 1999 |
|  |  | GB_PR4:AC006236 | 127593 AC006236 | Homo sapiens chromosome 17, clone hCIT.162_E_12, complete sequence. | Homo sapiens | 37,191 | 29 Dec. 1998 |
| rxa02229 | 948 | GB_BA1:MSGY154 | 40221 AD000002 | Mycobacterium tuberculosis sequence from clone y154. | Mycobacterium tuberculosis | 53,541 | 03 Dec. 1996 |
|  |  | GB_BA1:MTCY154 | 13935 Z98209 | Mycobacterium tuberculosis H37Rv complete genome; segment 121/162. | Mycobacterium tuberculosis | 40,407 | 17 Jun. 1998 |
|  |  | GB_BA1:U00019 | 36033 U00019 | Mycobacterium leprae cosmid B2235. | Mycobacterium leprae | 40,541 | 01 Mar. 1994 |
| rxa02234 | 3462 | GB_BA1:MSGB937CS | 38914 L78820 | Mycobacterium leprae cosmid B937 DNA sequence. | Mycobacterium leprae | 66,027 | 15 Jun. 1996 |
|  |  | GB_BA1:MTCY2B12 | 20431 Z81011 | Mycobacterium tuberculosis H37Rv complete genome; segment 61/162. | Mycobacterium tuberculosis | 71,723 | 18 Jun. 1998 |
|  |  | GB_BA2:U01072 | 4393 U01072 | Mycobacterium bovis BCG orotidine-5'-monophosphate decarboxylase (uraA) gene. | Mycobacterium bovis | 67,101 | 22 Dec. 1993 |
| rxa02235 | 727 | GB_BA1:MSU91572 | 960 U91572 | Mycobacterium smegmatis carbamoyl phosphate synthetase (pyrAB) gene, partial cds and orotidine 5'-monophosphate decarboxylase (pyrF) gene, complete cds. | Mycobacterium smegmatis | 60,870 | 22 Mar. 1997 |
|  |  | GB_HTG3:AC009364 | 192791 AC009364 | Homo sapiens chromosome 7, **SEQUENCING IN PROGRESS*, 57 | Homo sapiens | 37,994 | 1 Sep. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02237 | 693 | GB_HTG3:AC009364 | 192791 | AC009364 | *Homo sapiens* chromosome 7, *SEQUENCING IN PROGRESS*, 57 unordered pieces. | *Homo sapiens* | 37,994 | 1 Sep. 1999 |
| | | GB_BA1:MTCY21B4 | 39150 | Z80108 | *Mycobacterium tuberculosis* H37Rv complete genome; segment 62/162. | *Mycobacterium tuberculosis* | 55,844 | 23 Jun. 1998 |
| | | GB_BA2:AF077324 | 5228 | AF077324 | *Rhodococcus equi* strain 103 plasmid RE-VP1 fragment f. | *Rhodococcus equi* | 41,185 | 5 Nov. 1998 |
| | | GB_EST22:AU017763 | 586 | AU017763 | AU017763 Mouse two-cell stage embryo cDNA *Mus musculus* cDNA clone J0744A04 3', mRNA sequence. | *Mus musculus* | 38,616 | 19 Oct. 1998 |
| rxa02239 | 1389 | GB_BA1:MTCY21B4 | 39150 | Z80108 | *Mycobacterium tuberculosis* H37Rv complete genome; segment 62/162. | *Mycobacterium tuberculosis* | 56,282 | 23 Jun. 1998 |
| | | GB_HTG3:AC010745 | 193862 | AC010745 | *Homo sapiens* clone NH0549D18, **SEQUENCING IN PROGRESS**, 30 unordered pieces. | *Homo sapiens* | 36,772 | 21 Sep. 1999 |
| | | GB_HTG3:AC010745 | 193862 | AC010745 | *Homo sapiens* clone NH0549D18, *SEQUENCING IN PROGRESS*, 30 unordered pieces. | *Homo sapiens* | 36,772 | 21 Sep. 1999 |
| rxa02240 | 1344 | EM_PAT:E09855 | 1239 | E09855 | gDNA encoding S-adenosylmethionine synthetase. | *Corynebacterium glutamicum* | 99,515 | 07 Oct. 1997 (Rel. 52, Created) |
| | | GB_PAT:A37831 | 5392 | A37831 | Sequence 1 from Patent WO9408014. | *Streptomyces pristinaespiralis* | 63,568 | 05 Mar. 1997 |
| | | GB_BA2:AF117274 | 2303 | AF117274 | *Streptomyces spectabilis* flavoprotein homolog Dfp (dfp) gene, partial cds; and S-adenosylmethionine synthetase (metK) gene, complete cds. | *Streptomyces spectabilis* | 65,000 | 31 Mar. 1999 |
| rxa02246 | 1107 | EM_BA1:AB003693 | 5589 | AB003693 | *Corynebacterium ammoniagenes* DNA for rib operon, complete cds. | *Corynebacterium ammoniagenes* | 52,909 | 03 Oct. 1997 (Rel. 52, Created) |
| | | GB_PAT:E07957 | 5589 | E07957 | gDNA encoding at least guanosine triphosphate cyclohydrolase and riboflavin synthase. | *Corynebacterium ammoniagenes* | 52,909 | 29 Sep. 1997 |
| rxa02247 | 756 | GB_PAT:I32742 | 5589 | I32742 | Sequence 1 from U.S. Pat. No. 5589355. | Unknown. | 52,909 | 6 Feb. 1997 |
| | | GB_PAT:I32743 | 2689 | I32743 | Sequence 2 from U.S. Pat. No. 5589355. | Unknown. | 57,937 | 6 Feb. 1997 |
| | | EM_BA1:AB003693 | 5589 | AB003693 | *Corynebacterium ammoniagenes* DNA for rib operon, complete cds. | *Corynebacterium ammoniagenes* | 57,937 | 03 Oct. 1997 (Rel. 52, Created) |
| rxa02248 | 1389 | GB_PAT:I32742 | 5589 | I32742 | Sequence 1 from U.S. Pat. No. 5589355. | Unknown. | 52,909 | 6 Feb. 1997 |
| | | GB_PAT:I32742 | 5589 | I32742 | Sequence 1 from U.S. Pat. No. 5589355. | Unknown. | 61,843 | 6 Feb. 1997 |
| | | EM_BA1:AB003693 | 5589 | AB003693 | *Corynebacterium ammoniagenes* DNA for rib operon, complete cds. | *Corynebacterium ammoniagenes* | 61,843 | 03 Oct. 1997 (Rel. 52, Created) |
| rxa02249 | 600 | GB_PAT:E07957 | 5589 | E07957 | gDNA encoding at least guanosine triphosphate cyclohydrolase and riboflavin synthase. | *Corynebacterium ammoniagenes* | 61,843 | 29 Sep. 1997 |
| | | GB_PAT:I32742 | 5589 | I32742 | Sequence 1 from U.S. Pat. No. 5589355. | Unknown. | 64,346 | 6 Feb. 1997 |
| | | GB_PAT:I32743 | 2689 | I32743 | Sequence 2 from U.S. Pat. No. 5589355. | Unknown. | 64,346 | 6 Feb. 1997 |
| | | GB_PAT:E07957 | 5589 | E07957 | gDNA encoding at least guanosine triphosphate cyclohydrolase and riboflavin synthase. | *Corynebacterium ammoniagenes* | 56,318 | 29 Sep. 1997 |
| rxa02250 | 643 | GB_PAT:I32742 | 5589 | I32742 | Sequence 1 from U.S. Pat. No. 5589355. | Unknown. | 56,318 | 6 Feb. 1997 |
| | | EM_BA1:AB003693 | 5589 | AB003693 | *Corynebacterium ammoniagenes* DNA for rib operon, complete cds. | *Corynebacterium ammoniagenes* | 56,318 | 03 Oct. 1997 (Rel. 52, Created) |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02262 | 1269 | GB_BA1:CGL007732 | 4460 | AJ007732 | *Corynebacterium glutamicum* 3' ppc gene, secG gene, amt gene, ocd gene and 5' soxA gene. | *Corynebacterium glutamicum* | 100,000 | 7 Jan. 1999 |
| | | GB_BA1:CGAMTGENE | 2028 | X93513 | *C. glutamicum* amt gene. | *Corynebacterium glutamicum* | 100,000 | 29 May 1996 |
| | | GB_VI:HEHCMVCG | 229354 | X17403 | Human cytomegalovirus strain AD169 complete genome. | human herpesvirus 5 | 38,651 | 10 Feb. 1999 |
| rxa02263 | 488 | GB_BA1:CGL007732 | 4460 | AJ007732 | *Corynebacterium glutamicum* 3' ppc gene, secG gene, amt gene, ocd gene and 5' soxA gene. | *Corynebacterium glutamicum* | 100,000 | 7 Jan. 1999 |
| | | GB_BA1:CGL007732 | 4460 | AJ007732 | *Corynebacterium glutamicum* 3' ppc gene, secG gene, amt gene, ocd gene and 5' soxA gene. | *Corynebacterium glutamicum* | 37,526 | 7 Jan. 1999 |
| rxa02272 | 1368 | EM_PAT:E09373 | 1591 | E09373 | Creatinine deiminase gene. | *Bacillus* sp. | 96,928 | 08 Oct. 1997 (Rel. 52, Created) |
| | | GB_BA1:D38505 | 1591 | D38505 | *Bacillus* sp. gene for creatinine deaminase, complete cds | *Bacillus* sp. | 96,781 | 7 Aug. 1998 |
| | | GB_HTG2:AC006595 | 146070 | AC006595 | *Homo sapiens*, *SEQUENCING IN PROGRESS*, 4 unordered pieces. | *Homo sapiens* | 36,264 | 20 Feb. 1999 |
| rxa02281 | 1545 | GB_GSS12:AQ411010 | 551 | AQ411010 | HS_2257_B1_H02_MR CIT Approved Human Genomic Sperm Library D *Homo sapiens* genomic clone Plate = 2257 Col = 3 Row = P, genomic survey sequence. | *Homo sapiens* | 36,197 | 17 Mar. 1999 |
| | | GB_EST23:AI128623 | 363 | AI128623 | qa62c01.s1 Soares_fetal_heart_NbHH19W *Homo sapiens* cDNA clone IMAGE: 1691328 3', mRNA sequence. | *Homo sapiens* | 37,017 | 05 Oct. 1998 |
| | | GB_PL2:ATAC007019 | 102335 | AC007019 | *Arabidopsis thaliana* chromosome II BAC F7D8 genomic sequence, complete sequence. | *Arabidopsis thaliana* | 33,988 | 16 Mar. 1999 |
| rxa02299 | 531 | GB_BA2:AF116184 | 540 | AF116184 | *Corynebacterium glutamicum* L-aspartate-alpha-decarboxylase precursor (panD) gene, complete cds. | *Corynebacterium glutamicum* | 100,000 | 02 May 1999 |
| | | GB_GSS9:AQ164310 | 507 | AQ164310 | HS_2171_A2_E01_MR CIT Approved Human Genomic Sperm Library D *Homo sapiens* genomic clone Plate = 2171 Col = 2 Row = 1, genomic survey sequence. | *Homo sapiens* | 37,278 | 16 Oct. 1998 |
| rxa02311 | | GB_VI:MH68TKH | 4557 | X93468 | Murine herpesvirus type 68 thymidine kinase and glycoprotein H genes. | murine herpesvirus 68 | 40,288 | 3 Sep. 1996 |
| | | GB_HTG4:AC006091 | 176878 | AC006091 | *Drosophila melanogaster* chromosome 3 clone BACR48G05 (D475) RPCI-98 48.G.5 map 91F1-91F13 strain y; cn bw sp, *SEQUENCING IN PROGRESS*, 4 unordered pieces. | *Drosophila melanogaster* | 36,454 | 27 Oct. 1999 |
| | | GB_HTG4:AC006091 | 176878 | AC006091 | *Drosophila melanogaster* chromosome 3 clone BACR48G05 (D475) RPCI-98 48.G.5 map 91F1-91F13 strain y; cn bw sp, *SEQUENCING IN PROGRESS*, 4 unordered pieces. | *Drosophila melanogaster* | 36,454 | 27 Oct. 1999 |
| | | GB_BA2:RRU65510 | 16259 | U65510 | *Rhodospirillum rubrum* CO-induced hydrogenase operon (cooM, cooK, cooL, cooX, cooU, cooH) genes, iron sulfur protein (cooF) gene, carbon monoxide dehydrogenase (cooS) gene, carbon monoxide dehydrogenase accessory proteins (cooC, cooT, cooJ) genes, putative transcriptional activator (cooA) gene, nicotinate-nucleotide pyrophosphorylase (nadC) gene, complete cds, L-aspartate oxidase (nadB) gene, and alkyl hydroperoxide reductase (ahpC) gene, partial cds. | *Rhodospirillum rubrum* | 37,828 | 9 Apr. 1997 |
| rxa02315 | 1752 | GB_BA1:MSGY224 | 40051 | AD000004 | *Mycobacterium tuberculosis* sequence from clone y224. | *Mycobacterium tuberculosis* | 49,418 | 03 Dec. 1996 |
| | | GB_BA1:MTY25D10 | 40838 | Z95558 | *Mycobacterium tuberculosis* H37Rv complete genome; segment 28/162. | *Mycobacterium tuberculosis* | 49,360 | 17 Jun. 1998 |
| | | GB_BA1:MSGY224 | 40051 | AD000004 | *Mycobacterium tuberculosis* sequence from clone y224. | *Mycobacterium tuberculosis* | 38,150 | 03 Dec. 1996 |
| rxa02318 | 402 | GB_HTG3:AC011348 | 111083 | AC011348 | *Homo sapiens* chromosome 5 clone CIT-HSPC_303E13, *SEQUENCING IN PROGRESS*, 3 ordered pieces. | *Homo sapiens* | 35,821 | 06 Oct. 1999 |
| | | GB_HTG3:AC011348 | 111083 | AC011348 | *Homo sapiens* chromosome 5 clone CIT-HSPC_303E13, ***SEQUENCING | *Homo sapiens* | 35,821 | 06 Oct. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02319 | | GB_HTG3:AC011412 | 89234 | AC011412 | IN PROGRESS*, 3 ordered pieces. Homo sapiens chromosome 5 clone CIT978SKB_81K21, *SEQUENCING IN PROGRESS***, 3 ordered pieces. | Homo sapiens | 36,181 | 06 Oct. 1999 |
| | 1080 | GB_BA1:MSGY224 | 40051 | AD000004 | Mycobacterium tuberculosis sequence from clone y224. | Mycobacterium tuberculosis | 37,792 | 03 Dec. 1996 |
| | | GB_BA1:MTY25D10 | 40838 | Z95558 | Mycobacterium tuberculosis H37Rv complete genome; segment 28/162. | Mycobacterium tuberculosis | 37,792 | 17 Jun. 1998 |
| | | GB_EST23:AI117213 | 476 | AI117213 | ub83h02.r1 Soares 2NbMT Mus musculus cDNA clone IMAGE: 1395123 5', mRNA sequence. | Mus musculus | 35,084 | 2 Sep. 1998 |
| rxa02345 | 1320 | GB_BA1:BAPURKE | 2582 | X91189 | B. ammoniagenes purK and purE genes. | Corynebacterium ammoniagenes | 61,731 | 14 Jan. 1997 |
| rxa02350 | | GB_BA1:MTCY71 | 42729 | Z92771 | Mycobacterium tuberculosis H37Rv complete genome; segment 141/162. | Mycobacterium tuberculosis | 39,624 | 10 Feb. 1999 |
| | | GB_BA1:MTCY71 | 42729 | Z92771 | Mycobacterium tuberculosis H37Rv complete genome; segment 141/162. | Mycobacterium tuberculosis | 39,847 | 10 Feb. 1999 |
| | 618 | GB_BA1:BAPURKE | 2582 | X91189 | B. ammoniagenes purK and purE genes. | Corynebacterium ammoniagenes | 64,286 | 14 Jan. 1997 |
| rxa02373 | | GB_PL1:SC130KBXV | 129528 | X94335 | S. cerevisiae 130 kb DNA fragment from chromosome XV. | Saccharomyces cerevisiae | 36,617 | 15 Jul. 1997 |
| | | GB_PL1:SCXVORFS | 50984 | X90518 | S. cerevisiae DNA of 51 Kb from chromosome XV right arm. | Saccharomyces cerevisiae | 36,617 | 1 Nov. 1995 |
| | 1038 | GB_PAT:E00311 | 1853 | E00311 | DNA coding of 2,5-diketogluconic acid reductase. | unidentified | 56,123 | 29 Sep. 1997 |
| | | GB_PAT:I06030 | 1853 | I06030 | Sequence 4 from Patent EP 0305608. | Unknown. | 56,220 | 02 Dec. 1994 |
| | | GB_PAT:I00836 | 1853 | I00836 | Sequence 1 from U.S. Pat. No. 4758514. | Unknown. | 56,220 | 21 May 1993 |
| rxa02375 | 1350 | GB_BA2:CGU31230 | 3005 | U31230 | Corynebacterium glutamicum Obg protein homolog gene, partial cds, gamma glutamyl kinase (proB) gene, complete cds, and (unkdh) gene, complete cds. | Corynebacterium glutamicum | 99,332 | 2 Aug. 1996 |
| | | GB_HTG3:AC009946 | 169072 | AC009946 | Homo sapiens clone NH0012C17, *SEQUENCING IN PROGRESS*, 1 unordered pieces. | Homo sapiens | 36,115 | 8 Sep. 1999 |
| | | GB_HTG3:AC009946 | 169072 | AC009946 | Homo sapiens clone NH0012C17, *SEQUENCING IN PROGRESS*, 1 unordered pieces. | Homo sapiens | 36,115 | 8 Sep. 1999 |
| rxa02380 | 777 | GB_BA1:MTCY253 | 41230 | Z81368 | Mycobacterium tuberculosis H37Rv complete genome; segment 106/162. | Mycobacterium tuberculosis | 38,088 | 17 Jun. 1998 |
| | | GB_HTG4:AC010658 | 120754 | AC010658 | Drosophila melanogaster chromosome 3L/75C1 clone RPCI98-3B20, *SEQUENCING IN PROGRESS*, 78 unordered pieces. | Drosophila melanogaster | 35,817 | 16 Oct. 1999 |
| rxa02382 | | GB_HTG4:AC010658 | 120754 | AC010658 | Drosophila melanogaster chromosome 3L/75C1 clone RPCI98-3B20, *SEQUENCING IN PROGRESS*, 78 unordered pieces. | Drosophila melanogaster | 35,817 | 16 Oct. 1999 |
| | 1419 | GB_BA1:CGPROAGEN | 1783 | X82929 | C. glutamicum proA gene. | Corynebacterium glutamicum | 98,802 | 23 Jan. 1997 |
| | | GB_BA1:MTCY428 | 26914 | Z81451 | Mycobacterium tuberculosis H37Rv complete genome; segment 107/162. | Mycobacterium tuberculosis | 38,054 | 17 Jun. 1998 |
| | | GB_BA2:CGU31230 | 3005 | U31230 | Corynebacterium glutamicum Obg protein homolog gene, partial cds, gamma glutamyl kinase (proB) gene, complete cds, and (unkdh) gene, complete cds. | Corynebacterium glutamicum | 98,529 | 2 Aug. 1996 |
| rxa02400 | 693 | GB_BA1:CGACEA | 2427 | X75504 | C. glutamicum aceA gene and thiX genes (partial). | Corynebacterium glutamicum | 100,000 | 9 Sep. 1994 |
| | | GB_PAT:I86191 | 2135 | I86191 | Sequence 3 from U.S. Pat. No. 5700661. | Unknown. | 100,000 | 10 Jun. 1998 |
| | | GB_PAT:I13693 | 2135 | I13693 | Sequence 3 from U.S. Pat. No. 5439822. | Unknown. | 100,000 | 26 Sep. 1995 |
| rxa02432 | 1098 | GB_GSS15:AQ606842 | 574 | AQ606842 | HS_5404_B2_E07_T7A RPCI-11 Human Male BAC Library Homo sapiens genomic clone Plate = 980 Col = 14 Row = J, genomic survey sequence. | Homo sapiens | 39,716 | 10 Jun. 1999 |
| | | GB_EST1:T05804 | 406 | T05804 | EST03693 Fetal brain, Stratagene (cat#936206) Homo sapiens cDNA clone HFBDG63 similar to EST containing Alu repeat, mRNA sequence. | Homo sapiens | 37,915 | 30 Jun. 1993 |
| | | GB_PL1:AB006699 | 77363 | AB006699 | Arabidopsis thaliana genomic DNA, chromosome 5, P1 clone: MDJ22, complete sequence. | Arabidopsis thaliana | 35,526 | 20 Nov. 1999 |
| rxa02458 | | GB_BA2:AF114233 | 1852 | AF114233 | Corynebacterium glutamicum 5-enolpyruvylshikimate 3-phosphate synthase (aroA) gene, complete cds. | Corynebacterium glutamicum | 100,000 | 7 Feb. 1999 |
| | 1413 | GB_EST37:AW013061 | 578 | AW013061 | ODT-0033 Winter flounder ovary Pleuronectes americanus cDNA clone ODT- | Pleuronectes americanus | 39,175 | 10 Sep. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02469 | 1554 | GB_GSS15:AQ650027 | 728 | AQ650027 | 0033 5' similar to FRUCTOSE-BISPHOSPHATE ALDOLASE B (LIVER), mRNA sequence. Sheared DNA-5L2.TF Sheared DNA Trypanosoma brucei genomic clone Sheared DNA-5L2, genomic survey sequence. | Trypanosoma brucei | 39,281 | 22 Jun. 1999 |
|  |  | GB_BA1:MTCY359 | 36021 | Z83859 | Mycobacterium tuberculosis H37Rv complete genome; segment 84/162. | Mycobacterium tuberculosis | 39,634 | 17 Jun. 1998 |
|  |  | GB_BA1:MLCB1788 | 39228 | AL008609 | Mycobacterium leprae cosmid B1788. | Mycobacterium leprae | 59,343 | 27 Aug. 1999 |
|  |  | GB_BA1:SCAJ10601 | 4692 | AJ010601 | Streptomyces coelicolor A3(2) DNA for whiD and whiK loci. | Streptomyces coelicolor | 48,899 | 17 Sep. 1998 |
| rxa02497 | 1050 | GB_BA2:CGU31224 | 422 | U31224 | Corynebacterium glutamicum (ppx) gene, partial cds. | Corynebacterium glutamicum | 96,445 | 2 Aug. 1996 |
|  |  | GB_BA1:MTCY20G9 | 37218 | Z77162 | Mycobacterium tuberculosis H37Rv complete genome; segment 25/162. | Mycobacterium tuberculosis | 59,429 | 17 Jun. 1998 |
|  |  | GB_BA1:SCE7 | 16911 | AL049819 | Streptomyces coelicolor cosmid E7. | Streptomyces coelicolor | 39,510 | 10 May 1999 |
| rxa02499 | 933 | GB_BA2:CGU31225 | 1817 | U31225 | Corynebacterium glutamicum L-proline: NADP+ 5-oxidoreductase (proC) gene, complete cds. | Corynebacterium glutamicum | 97,749 | 2 Aug. 1996 |
|  |  | GB_BA1:NG17PILA | 1920 | X13965 | Neisseria gonorrhoeae pilA gene. | Neisseria gonorrhoeae | 43,249 | 30 Sep. 1993 |
|  |  | GB_HTG2:AC007984 | 129715 | AC007984 | Drosophila melanogaster chromosome 3 clone BACR05C10 (D781) RPCI-98 05.C.10 map 97D-97E strain y; cn bw sp, *SEQUENCING IN PROGRESS*, 87 unordered pieces. | Drosophila melanogaster | 33,406 | 2 Aug. 1999 |
| rxa02501 | 1188 | GB_BA1:MTCY20G9 | 37218 | Z77162 | Mycobacterium tuberculosis H37Rv complete genome; segment 25/162. | Mycobacterium tuberculosis | 39,357 | 17 Jun. 1998 |
|  |  | GB_BA1:U00018 | 42991 | U00018 | Mycobacterium leprae cosmid B2168. | Mycobacterium leprae | 51,768 | 01 Mar. 1994 |
|  |  | GB_VI:HE1CG | 152261 | X14112 | Herpes simplex virus (HSV) type 1 complete genome. | human herpesvirus 1 | 39,378 | 17 Apr. 1997 |
| rxa02503 | 522 | GB_PR3:AC005328 | 35414 | AC005328 | Homo sapiens chromosome 19, cosmid R26660, complete sequence. | Homo sapiens | 39,922 | 28 Jul. 1998 |
|  |  | GB_PR3:AC005545 | 43514 | AC005545 | Homo sapiens chromosome 19, cosmid R26634, complete sequence. | Homo sapiens | 39,922 | 3 Sep. 1998 |
|  |  | GB_PR3:AC005328 | 35414 | AC005328 | Homo sapiens chromosome 19, cosmid R26660, complete sequence. | Homo sapiens | 34,911 | 28 Jul. 1998 |
| rxa02504 | 681 | GB_BA1:MTCY20G9 | 37218 | Z77162 | Mycobacterium tuberculosis H37Rv complete genome; segment 25/162. | Mycobacterium tuberculosis | 54,940 | 17 Jun. 1998 |
|  |  | GB_PR3:AC005328 | 35414 | AC005328 | Homo sapiens chromosome 19, cosmid R26660, complete sequence. | Homo sapiens | 41,265 | 28 Jul. 1998 |
|  |  | GB_PR3:AC005545 | 43514 | AC005545 | Homo sapiens chromosome 19, cosmid R26634, complete sequence. | Homo sapiens | 41,265 | 3 Sep. 1998 |
| rxa02516 | 1386 | GB_BA1:MLCL536 | 36224 | Z99125 | Mycobacterium leprae cosmid L536. | Mycobacterium leprae | 37,723 | 04 Dec. 1998 |
|  |  | GB_BA1:U00013 | 35881 | U00013 | Mycobacterium leprae cosmid B1496. | Mycobacterium leprae | 37,723 | 01 Mar. 1994 |
|  |  | GB_BA1:MTV007 | 32806 | AL021184 | Mycobacterium tuberculosis H37Rv complete genome; segment 64/162. | Mycobacterium tuberculosis | 61,335 | 17 Jun. 1998 |
| rxa02517 | 570 | GB_BA1:MLCL536 | 36224 | Z99125 | Mycobacterium leprae cosmid L536. | Mycobacterium leprae | 37,018 | 04 Dec. 1998 |
|  |  | GB_BA1:U00013 | 35881 | U00013 | Mycobacterium leprae cosmid B1496. | Mycobacterium leprae | 37,018 | 01 Mar. 1994 |
|  |  | GB_BA1:SCC22 | 22115 | AL096839 | Streptomyces coelicolor cosmid C22. | Streptomyces coelicolor | 37,071 | 12 Jul. 1999 |
| rxa02532 | 1170 | GB_OV:AF137219 | 831 | AF137219 | Amia calva mixed lineage leukemia-like protein (MII) gene, partial cds. | Amia calva | 36,853 | 7 Sep. 1999 |
|  |  | GB_EST30:AI645057 | 301 | AI645057 | vs52a10.y1 Stratagene mouse Tcell 937311 Mus musculus cDNA clone IMAGE: 1149882 5', mRNA sequence. | Mus musculus | 41,860 | 29 Apr. 1999 |
|  |  | GB_EST20:AA822595 | 429 | AA822595 | vs52a10.r1 Stratagene mouse Tcell 937311 Mus musculus cDNA clone IMAGE: 1149882 5', mRNA sequence. | Mus musculus | 42,353 | 17 Feb. 98 |
| rxa02536 | 879 | GB_HTG2:AF130866 | 118874 | AF130866 | Homo sapiens chromosome 8 clone PAC 172N13 map 8q24, *SEQUENCING IN PROGRESS*, in unordered pieces. | Homo sapiens | 40,754 | 21 Mar. 1999 |
|  |  | GB_HTG2:AF130866 | 118874 | AF130866 | Homo sapiens chromosome 8 clone PAC 172N13 map 8q24, *SEQUENCING IN PROGRESS*, in unordered pieces. | Homo sapiens | 40,754 | 21 Mar. 1999 |
| rxa02550 | 1434 | GB_PL1:ATT12I5 | 84499 | AL035522 | Arabidopsis thaliana DNA chromosome 4, BAC clone T12J5 (ESSAII project). | Arabidopsis thaliana | 35,063 | 24 Feb. 1999 |
|  |  | GB_BA1:MTCY279 | 9150 | Z97991 | Mycobacterium tuberculosis H37Rv complete genome; segment 17/162. | Mycobacterium tuberculosis | 37,773 | 17 Jun. 1998 |
|  |  | GB_BA1:MSGB1970CS | 39399 | L78815 | Mycobacterium leprae cosmid B1970 DNA sequence. | Mycobacterium leprae | 39,024 | 15 Jun. 1996 |
| rxa02559 | 1026 | GB_BA2:SC2H4 | 25970 | AL031514 | Streptomyces coelicolor cosmid 2H4. | Streptomyces coelicolor A3(2) | 37,906 | 19 Oct. 1999 |
|  |  | GB_BA1:MTV004 | 69350 | AL009198 | Mycobacterium tuberculosis H37Rv complete genome; segment 144/162. | Mycobacterium tuberculosis | 47,358 | 18 Jun. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_PAT:I28684 | 5100 | I28684 | Sequence 1 from U.S. Pat. No. 5573915. | Unknown. | 39,138 | 6 Feb. 1997 |
| | | GB_BA1:MTU27357 | 5100 | U27357 | *Mycobacterium tuberculosis* cyclopropane mycolic acid synthase (cma1) gene, complete cds. | *Mycobacterium tuberculosis* | 39,138 | 26 Sep. 1995 |
| rxa02622 | 1683 | GB_BA2:AE001780 | 11997 | AE001780 | *Thermotoga maritima* section 92 of 136 of the complete genome. | *Thermotoga maritima* | 44,914 | 2 Jun. 1999 |
| | | GB_OV:AF064564 | 49254 | AF064564 | *Fugu rubripes* neurofibromatosis type 1 (NF1), A-kinase anchor protein (AKAP84), BAW protein (BAW), and WSB1 protein (WSB1) genes, complete cds. | *Fugu rubripes* | 39,732 | 17 Aug. 1999 |
| | | GB_OV:AF064564 | 49254 | AF064564 | *Fugu rubripes* neurofibromatosis type 1 (NF1), A-kinase anchor protein (AKAP84), BAW protein (BAW), and WSB1 protein (WSB1) genes, complete cds. | *Fugu rubripes* | 36,703 | 17 Aug. 1999 |
| rxa02623 | 714 | GB_GSS5:AQ818728 | 444 | AQ818728 | HS_5268_A1_G09_SP6E RPCI-11 Human Male BAC Library *Homo sapiens* genomic clone Plate = 844 Col = 17 Row = M, genomic survey sequence. | *Homo sapiens* | 38,801 | 26 Aug. 1999 |
| | | GB_HTG5:AC011083 | 198586 | AC011083 | *Homo sapiens* chromosome 9 clone RP11-111M7 map 9, WORKING DRAFT SEQUENCE, 51 unordered pieces. | *Homo sapiens* | 35,714 | 19 Nov. 1999 |
| | | GB_GSS6:AQ826948 | 544 | AQ826948 | HS_5014_A2_C12_T7A RPCI-11 Human Male BAC Library *Homo sapiens* genomic clone Plate = 590 Col = 24 Row = E, genomic survey sequence. | *Homo sapiens* | 39,146 | 27 Aug. 1999 |
| rxa02629 | 708 | GB_VI:BRSMGP | 462 | M86652 | Bovine respiratory syncytial virus membrane glycoprotein mRNA, complete cds. | Bovine respiratory syncytial virus | 37,013 | 28 Apr. 1993 |
| | | GB_VI:BRSMGP | 462 | M86652 | Bovine respiratory syncytial virus membrane glycoprotein mRNA, complete cds. | Bovine respiratory syncytial virus | 37,013 | 28 Apr. 1993 |
| rxa02645 | 1953 | GB_PAT:A45577 | 1925 | A45577 | Sequence 1 from Patent WO9519442. | *Corynebacterium glutamicum* | 39,130 | 07 Mar. 1997 |
| | | GB_PAT:A45581 | 1925 | A45581 | Sequence 5 from Patent WO9519442. | *Corynebacterium glutamicum* | 39,130 | 07 Mar. 1997 |
| | | GB_BA1:CORILVA | 1925 | L01508 | *Corynebacterium glutamicum* threonine dehydratase (ilvA) gene, complete cds. | *Corynebacterium glutamicum* | 39,130 | 26 Apr. 1993 |
| rxa02646 | 1392 | GB_BA1:CORILVA | 1925 | L01508 | *Corynebacterium glutamicum* threonine dehydratase (ilvA) gene, complete cds. | *Corynebacterium glutamicum* | 99,138 | 26 Apr. 1993 |
| | | GB_PAT:A45585 | 1925 | A45585 | Sequence 9 from Patent WO9519442. | *Corynebacterium glutamicum* | 99,066 | 07 Mar. 1997 |
| | | GB_PAT:A45583 | 1925 | A45583 | Sequence 7 from Patent WO9519442. | *Corynebacterium glutamicum* | 99,066 | 07 Mar. 1997 |
| rxa02648 | 1326 | GB_OV:ICTCNC | 2049 | M83111 | *Ictalurus punctatus* cyclic nucleotide-gated channel RNA sequence. | *Ictalurus punctatus* | 38,402 | 24 May 1993 |
| | | GB_EST11:AA265464 | 345 | AA265464 | mx91c06.r1 Soares mouse NML *Mus musculus* cDNA clone IMAGE: 693706 5', mRNA sequence. | *Mus musculus* | 38,655 | 20 Mar. 1997 |
| rxa02653 | 480 | GB_GSS8:AQ006950 | 480 | AQ006950 | CIT-HSP-2294E14.TR CIT-HSP *Homo sapiens* genomic clone 2294E14, genomic survey sequence. | *Homo sapiens* | 36,074 | 27 Jun. 1998 |
| rxa02687 | 1068 | GB_BA1:CORPHEA | 1088 | M13774 | *C. glutamicum* pheA gene encoding prephenate dehydratase, complete cds. | *Corynebacterium glutamicum* | 99,715 | 26 Apr. 1993 |
| | | GB_PAT:E04483 | 948 | E04483 | DNA encoding prephenate dehydratase. | *Corynebacterium glutamicum* | 98,523 | 29 Sep. 1997 |
| | | GB_PAT:E06110 | 948 | E06110 | DNA encoding prephenate dehydratase. | *Corynebacterium glutamicum* | 98,523 | 29 Sep. 1997 |
| rxa02717 | 1005 | GB_PL1:HVCH4H | 59748 | Y14573 | *Hordeum vulgare* DNA for chromosome 4H. | *Hordeum vulgare* | 36,593 | 25 Mar. 1999 |
| | | GB_PR2:HS310H5 | 29718 | Z69705 | Human DNA sequence from cosmid 310H5 from a contig from the tip of the short arm of chromosome 16, spanning 2 Mb of 16p13.3. Contains EST and CpG island. | *Homo sapiens* | 36,089 | 22 Nov. 1999 |
| | | GB_PR3:AC004754 | 39188 | AC004754 | *Homo sapiens* chromosome 16, cosmid clone RT286 (LANL), complete sequence. | *Homo sapiens* | 36,089 | 28 May 1998 |
| rxa02754 | 1461 | GB_HTG2:AC008223 | 130212 | AC008223 | *Drosophila melanogaster* chromosome 3 clone BACR16I18 (D815) RPCI-98 16.I.18 map 95A-95A strain y; cn bw sp, **SEQUENCING IN PROGRESS**, | *Drosophila melanogaster* | 32,757 | 2 Aug. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG2:AC008223 | 130212 | AC008223 | Drosophila melanogaster chromosome 3 clone BACR16I18 (D815) RPCI-98 16.I.18 map 95A-95A strain y; cn bw sp, **SEQUENCING IN PROGRESS**, 101 unordered pieces. | Drosophila melanogaster | 32,757 | 2 Aug. 1999 |
| rxa02758 | 1422 | GB_BA1:MTCY71 | 42729 | Z92771 | Mycobacterium tuberculosis H37Rv complete genome; segment 141/162. | Mycobacterium tuberculosis | 37,838 | 10 Feb. 1999 |
| | | GB_HTG5:AC011678 | 171967 | AC011678 | Homo sapiens clone 14_B_7, *SEQUENCING IN PROGRESS*, 20 unordered pieces. | Homo sapiens | 35,331 | 5 Nov. 1999 |
| | | GB_HTG5:AC011678 | 171967 | AC011678 | Homo sapiens clone 14_B_7, *SEQUENCING IN PROGRESS*, 20 unordered pieces. | Homo sapiens | 33,807 | 5 Nov. 1999 |
| | | GB_BA2:AF064070 | 23183 | AF064070 | Burkholderia pseudomallei putative dihydroorotase (pyrC) gene, partial cds; putative 1-acyl-sn-glycerol-3-phosphate acyltransferase (plsC), putative diadenosine tetraphosphatase (apaH), putative UDP-glucose 4-epimerase genes, complete cds; and putative galactosyl transferase gene, partial cds. | Burkholderia pseudomallei | 36,929 | 20 Jan. 1999 |
| rxa02771 | 678 | GB_BA2:AF038651 | 4077 | AF038651 | Corynebacterium glutamicum dipeptide-binding protein (dciAE) gene, partial cds; adenine phosphoribosyltransferase (apt) and GTP pyrophosphokinase (rel) genes, complete cds; and unknown gene. | Corynebacterium glutamicum | 99,852 | 14 Sep. 1998 |
| | | GB_IN1:CELT19B4 | 37121 | U80438 | Caenorhabditis elegans cosmid T19B4. | Caenorhabditis elegans | 43,836 | 04 Dec. 1996 |
| | | GB_EST36:AV193572 | 360 | AV193572 | AV193572 Yuji Kohara unpublished cDNA: Strain N2 hermaphrodite embryo Caenorhabditis elegans cDNA clone yk61i8h8 5', mRNA sequence. | Caenorhabditis elegans | 48,588 | 22 Jul. 1999 |
| rxa02772 | 1158 | GB_BA2:AF038651 | 4077 | AF038651 | Corynebacterium glutamicum dipeptide-binding protein (dciAE) gene, partial cds; adenine phosphoribosyltransferase (apt) and GTP pyrophosphokinase (rel) genes, complete cds; and unknown gene. | Corynebacterium glutamicum | 99,914 | 14 Sep. 1998 |
| | | GB_BA1:MTCY227 | 35946 | Z77724 | Mycobacterium tuberculosis H37Rv complete genome; segment 114/162. | Mycobacterium tuberculosis | 38,339 | 17 Jun. 1998 |
| | | GB_BA1:U00011 | 40429 | U00011 | Mycobacterium leprae cosmid B1177. | Mycobacterium leprae | 38,996 | 01 Mar. 1994 |
| rxa02790 | 1266 | GB_BA1:MTCY159 | 33818 | Z83863 | Mycobacterium tuberculosis H37Rv complete genome; segment 111/162. | Mycobacterium tuberculosis | 37,640 | 17 Jun. 1998 |
| | | GB_PR4:AC006581 | 172931 | AC006581 | Homo sapiens 12p21 BAC RPCI11-259O18 (Roswell Park Cancer Institute Human BAC Library) complete sequence. | Homo sapiens | 37,906 | 3 Jun. 1999 |
| | | GB_PR4:AC006581 | 172931 | AC006581 | Homo sapiens 12p21 BAC RPCI11-259O18 (Roswell Park Cancer Institute Human BAC Library) complete sequence. | Homo sapiens | 35,280 | 3 Jun. 1999 |
| rxa02791 | 951 | GB_BA1:MTCY159 | 33818 | Z83863 | Mycobacterium tuberculosis H37Rv complete genome; segment 111/162. | Mycobacterium tuberculosis | 39,765 | 17 Jun. 1998 |
| | | GB_OV:CHKCEK2 | 3694 | M35195 | Chicken tyrosine kinase (cek2) mRNA, complete cds. | Gallus gallus | 38,937 | 28 Apr. 1993 |
| | | GB_BA1:MSASDASK | 5037 | Z17372 | M. smegmatis asd, ask-alpha, and ask-beta genes. | Mycobacterium smegmatis | 38,495 | 9 Aug. 1994 |
| rxa02802 | 1194 | GB_EST24:AI223401 | 169 | AI223401 | qg48g01.x1 Soares_testis_NHT Homo sapiens cDNA clone IMAGE: 1838448 3' similar to WP: C25D7.8 CE08394;, mRNA sequence. | Homo sapiens | 40,828 | 27 Oct. 1998 |
| | | GB_EST24:AI223401 | 169 | AI223401 | qg48g01.x1 Soares_testis_NHT Homo sapiens cDNA clone IMAGE: 1838448 3' similar to WP: C25D7.8 CE08394;, mRNA sequence. | Homo sapiens | 40,828 | 27 Oct. 1998 |
| rxa02814 | 494 | GB_BA1:MTCY7D11 | 22070 | Z95120 | Mycobacterium tuberculosis H37Rv complete genome; segment 138/162. | Mycobacterium tuberculosis | 58,418 | 17 Jun. 1998 |
| | | GB_BA1:MTCY7D11 | 22070 | Z95120 | Mycobacterium tuberculosis H37Rv complete genome; segment 138/162. | Mycobacterium tuberculosis | 40,496 | 17 Jun. 1998 |
| | | GB_PR1:HSAJ2962 | 778 | AJ002962 | Homo sapiens mRNA for hB-FABP. | Homo sapiens | 39,826 | 8 Jan. 1998 |
| rxa02843 | 608 | GB_BA1:CGAJ4934 | 1160 | AJ004934 | Corynebacterium glutamicum dapD gene, complete CDS. | Corynebacterium glutamicum | 100,000 | 17 Jun. 1998 |
| | | GB_BA1:MTCI364 | 29540 | Z93777 | Mycobacterium tuberculosis H37Rv complete genome; segment 52/162. | Mycobacterium tuberculosis | 37,710 | 17 Jun. 1998 |
| | | GB_BA1:MLU15180 | 38675 | U15180 | Mycobacterium leprae cosmid B1756. | Mycobacterium leprae | 39,626 | 09 Mar. 1995 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxs03205 | 963 | GB_BA1:BLSIGBGN | 2906 | Z49824 | *B. lactofermentum* orf1 gene and sigB gene. | *Corynebacterium glutamicum* | 98,854 | 25 Apr. 1996 |
| | | GB_EST21:AA980237 | 377 | AA980237 | Soares_mammary_gland_NbMMG *Mus musculus* cDNA clone IMAGE: 1348414 5' similar to TR: Q61025 Q61025 HYPOTHETICAL 15.2 KD PROTEIN.;, mRNA sequence. | *Mus musculus* | 41,489 | 27 May 1998 |
| | | GB_EST23:AI158316 | 371 | AI158316 | ud27c05.r1 Soares_thymus_2NbMT *Mus musculus* cDNA clone IMAGE: 1447112 5', mRNA sequence. | *Mus musculus* | 38,005 | 30 Sep. 1998 |
| rxs03223 | 1237 | GB_IN1:LMFL2743 | 38368 | AL031910 | *Leishmania major* Friedlin chromosome 4 cosmid L2743. | *Leishmania major* | 39,869 | 15 Dec. 1999 |
| | | GB_PR3:HSDJ61B2 | 119666 | AL096710 | Human DNA sequence from clone RP1-61B2 on chromosome 6p11.2-12.3 Contains isoforms 1 and 3 of BPAG1 (bullous pemphigoid antigen 1 (230/240 kD), an exon of a gene similar to murine MACF cytoskeletal protein, STSs and GSSs, complete sequence. | *Homo sapiens* | 34,930 | 17 Dec. 1999 |
| | | GB_PR3:HSDJ61B2 | 119666 | AL096710 | Human DNA sequence from clone RP1-61B2 on chromosome 6p11.2-12.3 Contains isoforms 1 and 3 of BPAG1 (bullous pemphigoid antigen 1 (230/240 kD), an exon of a gene similar to murine MACF cytoskeletal protein, STSs and GSSs, complete sequence. | *Homo sapiens* | 34,634 | 17 Dec. 1999 |

SEQUENCE LISTING (1158 sequences)

SEQ ID NO: 1 - DNA, 948 bp, Corynebacterium glutamicum
  CDS (101)..(925): RXA02229
gctggttcaacagagaccaccgcgtgtcctgggtcgacgcctctggcgatcccaccgcacaagccttggagattttgggtctacaatagcgagggtgaatttgaccatcccctttgccaaaggccacgccaccgaaaacgacttcatcatcatccccgatgaggatgcgcgcctagatttaactccagaaatggtggtcacgctgtgtgaccgccgcgccgggatcggtgctgatggtatcctccgcgtggttaaagctgcagacgtagaaggctccacggtcgacccatcgctgtggttcatggattaccgcaacgccgatggatctttggctgaaatgtgcggcaatggtgtgcgcctgttcgcgcactggctgtactcccgcggtcttgttgataatacgagctttgatatcggtacccgcgccggtgtccgccacgttgatattttgcaggcagatcaacattctgcgcaggtccgcgttgatatgggcatccctgacgtcacgggattatccacctgcgacatcaacggccaagtattcgctggccttggcgttgatatgggtaacccacacctagcgtgcgttgtgccgggcttaagtgcgtcggctcttgccgatatggaactgcgcgcacctacgtttgatcaggaattcttcccccacggtgtgaacgtagaaatcgtcacagaattagaagatgacgcagtatcgatgcgcgtgtgggaacgcggagtgggcgaaacccgctcctgtggcacgggaaccgttgctgcagcgtgtgctgctttagctgatgctggattgggagaaggcacagctaaagtgtgcgttccacgtggggaagtagaagtccagatctttgacgacggctccacactcaccggcccaagcgccatcatcgcactcggtgaggtgcagatctaagattcgcgattgtagttcgg

SEQ ID NO: 2 - protein, 275 aa, Corynebacterium glutamicum
LTIPFAKGHATENDFIIIPDEDARLDLTPEMVVTLCDRRAGIGADGILRVVKAADVEGSTVDPSLWFMDYRNADGSLAEMCGNGVRLFAHWLYSRGLVDNTSFDIGTRAGVRHVDILQADQHSAQVRVDMGIPDVTGLSTCDINGQVFAGLGVDMGNPHLACVVPGLSASALADMELRAPTFDQEFFPHGVNVEIVTELEDDAVSMRVWERGVGETRSCGTGTVAAACAALADAGLGEGTAKVCVPRGEVEVQIFDDGSTLTGPSAIIALGEVQI

SEQ ID NO: 3 - DNA, 1491 bp, Corynebacterium glutamicum
  CDS (101)..(1468): RXS02970
aaccgacaaaacagccgttcacgtgctaaagcagctcggcttgatctagggtgaggtgagttatttaaagacttcataatattttggggagtgaactggtttggcattgaagggttacaccaactttgacggtgaattcatcgaattcggatctgtgcaagcaaaagaagaggaaaaacgggcattcgacaacgatcgcgcgcacgttttccactcctggtccgcgcaggacaaaatcagccccaaagtatgggcagctgccgaaggttccacgctgtacgacttcgacggcaacgccttcatcgacatgggttcccaacttgtctcggcaaacttaggccacaacaaccctcgattagttgaggcgatccagcgccaagcagcccggttgaccaacatcaacccggccttcggcaatgatgtgcgctctgatgttgctgcaaagatcgtgtcgatggcccgtggcgaattctcccacgtgtttttcaccaacggcggcgccgacgccatcgagcactccatccgcatggctcgcctgcacaccggacgcaacaaaattctgtccgcataccgcagctaccacggcgcaaccggatccgcgatgatgctcaccggcgaacaccgccgcctgggcaaccccaccaccgacccagatatctaccacttctgggcaccattcctgcaccactcctcattctttgccaccacccaagaagaagaatgcgaacgcgcactcaagcacttggaagatgtcatcgcgtttgaaggtgctggcatgatcgcagcgatcgtcctggagccagtggtgggatcatcaggaatcatcctgccaccagcaggttacttaaatggcgtgcgcgaactttgcaacaagcacggcatcctcttcatcgccgacgaagtcatggtcggattcggacgcaccggaaaactgtttgcttacgagcatgctggcgacgatttccagccagacatgatcaccttcgccaagggtgttaacgcaggttacgccccactcggtggcatcgtgatgacccaatcaatccgcgataccttcggatcagaggcatactccggcggactcacctactccggacacccacttgcagtagcacccgccaaggcagcgctggagatttacgcggaaggagagatcattccacgcgtagctcgacttggcgctgaactgatcgaacctcgccttcgtgaactagcggaagaaaacgtagcgatcgctgacgtgcggggcatcggattcttctgggcagtggagttcaatgcagacgccactgccatggctgccggtgctgcagaattcaaggaacgcggcgtgtggccgatgatctccggcaaccgattccacatcgcgccgccgctgaccaccactgatgacgaattggtagcactgctggacgcggtggaagctgcagcccaagctgtcgagctgaccttcgctggggcgttgttctaagttttctagataacaaggcc

SEQ ID NO: 4 - protein, 456 aa, Corynebacterium glutamicum
LALKGYTNFDGEFIEFGSVQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 5 - DNA, 1330 bp, Corynebacterium glutamicum
  CDS (101)..(1330): FRXA01009
aaccgacaaaacagccgttcacgtgctaaagcagctcggcttgatctagggtgaggtgagttatttaaagacttcataatattttggggagtgaactggtttggcattgaagggttacaccaactttgacggtgaattcatcgaattcggatctgtgcaagcaaaagaagaggaaaaacgggcattcgacaacgatcgcgcgcacgttttccactcctggtccgcgcaggacaaaatcagccccaaagtatgggcagctgccgaaggttccacgctgtacgacttcgacggcaacgccttcatcgacatgggttcccaacttgtctcggcaaacttaggccacaacaaccctcgattagttgaggcgatccagcgccaagcagcccggttgaccaacatcaacccggccttcggcaatgatgtgcgctctgatgttgctgcaaagatcgtgtcgatggcccgtggcgaattctcccacgtgtttttcaccaacggcggcgccgacgccatcgagcactccatccgcatggctcgcctgcacaccggacgcaacaaaattctgtccgcataccgcagctaccacggcgcaaccggatccgcgatgatgctcaccggcgaacaccgccgcctgggcaaccccaccaccgacccagatatctaccacttctgggcaccattcctgcaccactcctcattctttgccaccacccaagaagaagaatgcgaacgcgcactcaagcacttggaagatgtcatcgcgtttgaaggtgctggcatgatcgcagcgatcgtcctggagccagtggtgggatcatcaggaatcatcctgccaccagcaggttacttaaatggcgtgcgcgaactttgcaacaagcacggcatcctcttcatcgccgacgaagtcatggtcggattcggacgcaccggaaaactgtttgcttacgagcatgctggcgacgatttccagccagacatgatcaccttcgccaagggtgttaacgcaggttacgccccactcggtggcatcgtgatgacccaatcaatccgcgataccttcggatcagaggcatactccggcggactcacctactccggacacccacttgcagtagcacccgccaaggcagcgctggagatttacgcggaaggagagatcattccacgcgtagctcgacttggcgctgaactgatcgaacctcgccttcgtgaactagcggaagaaaacgtagcgatcgctgacgtgcggggcatcggattcttctgggcagtggagttcaatgcagacgccactgccatggctgccggtgctgcagaattcaaggaacgcggc

SEQ ID NO: 6 - protein, 410 aa, Corynebacterium glutamicum
LALKGYTNFDGEFIEFGSVQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERG

SEQ ID NO: 7 - DNA, 792 bp, Corynebacterium glutamicum
  CDS (101)..(769): RXC02390
gctggtggtgctgacccatacgctggaactccaactgctgttgataccgccaagatgtttggccgcgaggatctcgtagctcgcttcgagtcataggccggtggagtggaccgcttttggcaccctgattctgctcaatttggtgggcagtttatccccggggcctgatacctttttcctcctccgcttagccacccgctccagagcgcacgcgatcgctggcgtcgccggcatcgtcaccggactcacggtgtgggtgacgctgacggtcgtgggagcagcggcgctgctcaccacttatccgtcgattctcggaatcatccagctcgtcggcggcacgtacctaagcttcattgggtacaagttgctgcgctcggcgtcgagagagcttatcgacgcccgccagttccgtttcaacgccgatgcccgacctatcccggatgcggtagaagcactgggaacccgcactcaggtatatcgacaaggtttggccaccaacctgtcaaaccctaaagttgtcatgtacttcgcggcaattctggctccgttgatgccagcgcacccatcaccggtgctggcgttctctatcatcgtggcgattttagtgcagacctttgttaccttctctgctgtgtgcctcattgtctctacggagcgtgtgcgcaaagcaatgctgcgtgcaggtccctggtttgacctgcttgctggcgttgtcttcctcgttgtgggtgtgactctgctgtatgaaggcctgaccggtttactcgggtaaaggcataaaaaatggcttcc

SEQ ID NO: 8 - protein, 223 aa, Corynebacterium glutamicum
VEWTAFGTLILLNLVGSLSPGPDTFFLLRLATRSRAHAIAGVAGIVTGLTVWVTLTVVGAAALLTTYPSILGIIQLVGGTYLSFIGYKLLRSASRELIDARQFRFNADARPIPDAVEALGTRTQVYRQGLATNLSNPKVVMYFAAILAPLMPAHPSPVLAFSIIVAILVQTFVTFSAVCLIVSTERVRKAMLRAGPWFDLLAGVVFLVVGVTLLYEGLTGLLG

SEQ ID NO: 9 - DNA, 897 bp, Corynebacterium glutamicum
  CDS (101)..(874): RXC01796
atgtaactcgatcaggtggaaatgcccgcaaaagtggcggcggtggccgagggatggccgttggtgcggcatcggtggcctgctactagtcgggctcttcttgctccttggcggtaaccctgccgagatcgaccaggttttaggtggcgatcaaacccagatcgagtctggagagtccaccggagccggcgactttgatcactgccaaaccggcgcagatgccaacgccagtgatgattgtcgcctttactacacctcattctccgtcaatgaaatgtggcagactttgcttccagctcaggctggtatcgaatacaccgagccgacattgactcttttcaaaaactccacccaaaccggctgcggtttcgcttctgcgtccactgggccgttttactgtccgtcagaccaagatgcttattttgacttgactttcttcgatcagatgcgtcagttcggtgcagaaaacgccccgcttgcccagatgtacatcgtggcgcacgagtacggccaccacgtccaaaacctcgagggcacactcggactgtccaattacaacgatccgggcgctgattccaacgccgtcaagatcgagttgcaggccgattgctacgcaggcatttgggctaatcactccagcgaaggcccggatccgctactccaacccatcaccgaatctgagctagattccgctctccttgctgcaagcgccgtgggcgacgacaatatccagcaacgatccggtggcgatgtcaatcctgaaagctggactcacggctcatcgcagcagcgcaaagacgcgttcctcgccggctacaacaccggccagatgagcgcctgcgacttcctcggccggggcgtctacaacgacgcttaaagcattgcttttcgacgtct

SEQ ID NO: 10 - protein, 258 aa, Corynebacterium glutamicum
LLLGGNPAEIDQVLGGDQTQIESGESTGAGDFDHCQTGADANASDDCRLYYTSFSVNEMWQTLLPAQAGIEYTEPTLTLFKNSTQTGCGFASASTGPFYCPSDQDAYFDLTFFDQMRQFGAENAPLAQMYIVAHEYGHHVQNLEGTLGLSNYNDPGADSNAVKIELQADCYAGIWANHSSEGPDPLLQPITESELDSALLAASAVGDDNIQQRSGGDVNPESWTHGSSQQRKDAFLAGYNTGQMSACDFLGRGVYNDA

SEQ ID NO: 11 - DNA, 771 bp, Corynebacterium glutamicum
  CDS (101)..(748): RXC01207
cttcatgatctcaccggcagagcgcgttttgttacagcgcgtaaactgtgactttgaaaaatttttgaacaatccgtacaccaacttcaggagaaaaacagtgagcagaatctatgactgtgccgaccaagactcccgtgcagcaggcctaaaggcggctgtcgatgcagtcaaagccggtcagctcgttgtccttcccacggataccctttatggactcggctgcgacgctttcaacaacgaggcagtagccaaccttctggccaccaaacaccgtggccccgatatgcccgttccagtgctcgtcggcagctgggacaccattcaaggacttgtgcactcctattctgcgcaggcaaaagcgcttgtggaggcgttctggcctggtggactgtccatcatcgttccgcaggcaccaagccttccgtggaaccttggcgatacccgtggcaccgtaatgctgcgcatgccactgcacccagttgccattgaattgctgcgccaaaccggaccaatggctgtctcctccgccaacatctccggacatactcctccaaccaccgtgctggaggctcgtcagcagctcaaccaaaatgtcgctgtctacctcgatggtggcgaatgcgcgctggccaccccttcaaccatcgtggatatttcaggccccgcaccaaagattttgcgtgagggtgccatcagcgcagaacgcgttggcgaagtacttggagtgtcggcagaaagcctgcgctaaatgggagtcggtttcgcggg

SEQ ID NO: 12 - protein, 216 aa, Corynebacterium glutamicum
VSRIYDCADQDSRAAGLKAAVDAVKAGQLVVLPTDTLYGLGCDAFNNEAVANLLATKHRGPDMPVPVLVGSWDTIQGLVHSYSAQAKALVEAFWPGGLSIIVPQAPSLPWNLGDTRGTVMLRMPLHPVAIELLRQTGPMAVSSANISGHTPPTTVLEARQQLNQNVAVYLDGGECALATPSTIVDISGPAPKILREGAISAERVGEVLGVSAESLR

SEQ ID NO: 13 - DNA, 1026 bp, Corynebacterium glutamicum
  CDS (101)..(1003): RXC00657
gtgcggatcgggtatccgcgctacacttagaggtgttagagatcatgagtttccacgaactgtaacgcaggattcaccaatcaatgaaaggtcgaccgacatgagcactgaagacattgtcgtcgtagcagtagatggctcggacgcctcaaaacaagctgttcggtgggctgcaaataccgccaacaaacgtggcattccacttcgcttggcttccagctacaccatgcctcagttcctctacgcagagggaatggttccaccacaagagcttttcgatgacctccaggccgaagccctggaaaagattaacgaagcccgtgacatcgcccatgaggtagcgccagaaatcaagatcgggcacaccatcgctgaaggcagtcccatcgacatgctgttggaaatgtctcccgatgccacaatgatcgtcatgggttcccgcggactcggcggactctccggaatggtcatgggctccgtctccggtgcagtggtcagccacgcaaagtgtccagtcgttgttgtccgtgaagacagcgcagtcaacgaagacagcaagtacggcccagtcgtcgtcggtgtggatggctccgaagtctcccaacaggcaaccgaatacgcatttgcggaagctgaagctcgtggcgccgaactcgttgcagttcacacctggatggacatgcaggtacaggcatcacttgcaggtcttgcagctgctcaacagcagtgggatgaagtggaacgtcagcaaaccgacatgctgatcgaacgcctcgcaccactggtggaaaagtacccaagtgtaaccgtcaagaagatcatcacccgtgaccgcccagttcgcgcacttgcagaagcatctgaaaacgcgcagctcctagtcgttggttcccatggtcgtggcggatttaagggcatgctccttggctccacctcccgcgcactgctgcaatccgcaccgtgcccaatgatggtggttcgcccacctgagaagattaagaagtagtttcttttaagtttcgatgc

SEQ ID NO: 14 - protein, 301 aa, Corynebacterium glutamicum
MSTEDIVVVAVDGSDASKQAVRWAANTANKRGIPLRLASSYTMPQFLYAEGMVPPQELFDDLQAEALEKINEARDIAHEVAPEIKIGHTIAEGSPIDMLLEMSPDATMIVMGSRGLGGLSGMVMGSVSGAVVSHAKCPVVVVREDSAVNEDSKYGPVVVGVDGSEVSQQATEYAFAEAEARGAELVAVHTWMDMQVQASLAGLAAAQQQWDEVERQQTDMLIERLAPLVEKYPSVTVKKIITRDRPVRALAEASENAQLLVVGSHGRGGFKGMLLGSTSRALLQSAPCPMMVVRPPEKIKK

SEQ ID NO: 15 - DNA, 1059 bp, Corynebacterium glutamicum
  CDS (101)..(1036): RXC00552
ccgccaacaaggcagcaaagctcgatccaattgacgccttgcgttatgagtaaaagcctcgtttttaaggtagccacacatcgcactagactgaagaactgtggctacctcaaaaattcttctttattacgcattcaccccgctctctgaccctaaagcggttcagctgtggcagcgtgagctctgcgagtcactgaatcttcgtggccgcatcctgatctccactcacggcatcaatggaaccgtgggcggagatattgatgattgcaaggcgtacattaaaaagacccgcgagtacccaggtttcaaccgcatgcagtttaagtggtccgagggtggcgctgaggatttcccaaagctcagtgtcaaagtccgcgatgagatcgttgccttcggcgctccagatgagctcaaagtggatgaaaacggcgtcgtcggtggcggcgttcacctgaaaccacagcaggtcaatgagcttgtggaagcccgtggcgatgaagttgtgttctttgacggccgcaacgcaatggaagcccagatcggcaagttcaaggacgctgttgtccctgacgtagaaaccactcatgatttcatcgcagaaattgagtctggaaaatacgacgatctcaaagacaagcctgtggtcacctactgcaccggcggaattcgttgtgagatcctgagttcactcatgatcaaccgtggtttcaaagaggtctaccaaatcgatggcggcatcgttcgctacggcgagcagtttggcaacaagggcctgtgggaaggctccctctacgttttcgataagcgcatgcatatggaattcggcgaggattacaaagaggtcggacactgcatccattgcgatactcccaccaacaaatttgagcactgcctcaacgaagatgattgccgcgagctcgtgttgatgtgccctgattgcttcgccaatgttgagacccgtcattgcaagcgcgaacgctgtgcagcaattgctgcggatttcgctgagcaaggaattgatccgctcgttacttcttaaaaagggtatggtggctgggt

SEQ ID NO: 16 - protein, 312 aa, Corynebacterium glutamicum
VATSKILLYYAFTPLSDPKAVQLWQRELCESLNLRGRILISTHGINGTVGGDIDDCKAYIKKTREYPGFNRMQFKWSEGGAEDFPKLSVKVRDEIVAFGAPDELKVDENGVVGGGVHLKPQQVNELVEARGDEVVFFDGRNAMEAQIGKFKDAVVPDVETTHDFIAEIESGKYDDLKDKPVVTYCTGGIRCEILSSLMINRGFKEVYQIDGGIVRYGEQFGNKGLWEGSLYVFDKRMHMEFGEDYKEVGHCIHCDTPTNKFEHCLNEDDCRELVLMCPDCFANVETRHCKRERCAAIAADFAEQGIDPLVTS

SEQ ID NO: 17 - DNA, 1578 bp, Corynebacterium glutamicum
  CDS (101)..(1555): RXN00351
gaaggctgctgctaagaaaacgaccaagaagaccactaagaaaactactaaaaagaccaccgcaaagaagaccacaaagaagtcttaagccggatcttatatggatgattccaatagctttgtagttgttgctaaccgtctgccagtggatatgactgtccacccagatggtagctatagcatctcccccagccccggtggccttgtcacggggctttcccccgttctggaacaacatcgtggatgttgggtcggatggcctggaactgtagatgttgcacccgaaccatttcgaacagatacgggtgttttgctgcaccctgttgtcctcactgcaagtgactatgaaggcttctacgagggcttttcaaacgcaacgctgtggcctcttttccacgatctgattgttactccggtgtacaacaccgattggtggcatgcgtttcgggaggtaaacctcaagttcgctgaagccgtgagccaagtggcggcacacggtgccactgtgtgggtgcaggactatcagctgttgctggttcctggcattttgcgccagatgcgccctgatttgaagatcggtttcttcctccacattcccttcccttcccctgatctgttccgtcagctgccgtggcgtgaagagattgttcgaggcatgctgggcgcagatttggtgggattccatttggttcaaaacgcagaaaacttccttgcgttaacccagcaggttgccggcactgccgggtctcatgtgggtcagccggacaccttgcaggtcagtggtgaagcattggtgcgtgagattggcgctcatgttgaaaccgctgacggaaggcgagttagcgtcggggcgttcccgatctcgattgatgttgaaatgtttggggaggcgtcgaaaagcgccgttcttgatcttttaaaaacgctcgacgagccggaaaccgtattcctgggcgttgaccgactggactacaccaagggcattttgcagcgcctgcttgcgtttgaggaactgctggaatccggcgcgttggaggccgacaaagctgtgttgctgcaggtcgcgacgccttcgcgtgagcgcattgatcactatcgtgtgtcgcgttcgcaggtcgaggaagccgtcggccgtatcaatggtcgtttcggtcgcatggggcgtcccgtggtgcattatctacacaggtcattgagcaaaaatgatctccaggtgctgtataccgcagccgatgtcatgctggttacgccttttaaagacggtatgaacttggtggctaaagaattcgtggccaaccaccgcgacggcactggtgctttggtgctgtccgaatttgccggcgcggccactgagctgaccggtgcgtatttatgcaacccatttgatgtggaatccatcaaacggcaaatggtggcagctgtccatgatttgaagcacaatccggaatctgcggcaacgcgaatgaaaacgaacagcgagcaggtctatacccacgacgtcaacgtgtgggctaatagtttcctggattgtttggcacagtcgggagaaaactcatgaaccgcgcacgaatcgcgacc

SEQ ID NO: 18 - protein, 485 aa, Corynebacterium glutamicum
MDDSNSFVVVANRLPVDMTVHPDGSYSISPSPGGLVTGLSPVLEQHRGCWVGWPGTVDVAPEPFRTDTGVLLHPVVLTASDYEGFYEGFSNATLWPLFHDLIVTPVYNTDWWHAFREVNLKFAEAVSQVAAHGATVWVQDYQLLLVPGILRQMRPDLKIGFFLHIPFPSPDLFRQLPWREEIVRGMLGADLVGFHLVQNAENFLALTQQVAGTAGSHVGQPDTLQVSGEALVREIGAHVETADGRRVSVGAFPISIDVEMFGEASKSAVLDLLKTLDEPETVFLGVDRLDYTKGILQRLLAFEELLESGALEADKAVLLQVATPSRERIDHYRVSRSQVEEAVGRINGRFGRMGRPVVHYLHRSLSKNDLQVLYTAADVMLVTPFKDGMNLVAKEFVANHRDGTGALVLSEFAGAATELTGAYLCNPFDVESIKRQMVAAVHDLKHNPESAATRMKTNSEQVYTHDVNVWANSFLDCLAQSGENS

SEQ ID NO: 19 - DNA, 1546 bp, Corynebacterium glutamicum
  CDS (101)..(1546): FRXA00351
gaaggctgctgctaagaaaacgaccaagaagaccactaagaaaactactaaaaagaccaccgcaaagaagaccacaaagaagtcttaagccggatcttatatggatgattccaatagctttgtagttgttgctaaccgtctgccagtggatatgactgtccacccagatggtagctatagcatctcccccagccccggtggccttgtcacggggctttcccccgttctggaacaacatcgtggatgttgggtcggatggcctggaactgtagatgttgcacccgaaccatttcgaacagatacgggtgttttgctgcaccctgttgtcctcactgcaagtgactatgaaggcttctacgagggcttttcaaacgcaacgctgtggcctcttttccacgatctgattgttactccggtgtacaacaccgattggtggcatgcgtttcgggaggtaaacctcaagttcgctgaagccgtgagccaagtggcggcacacggtgccactgtgtgggtgcaggactatcagctgttgctggttcctggcattttgcgccagatgcgccctgatttgaagatcggtttcttcctccacattcccttcccttcccctgatctgttccgtcagctgccgtggcgtgaagagattgttcgaggcatgctgggcgcagatttggtgggattccatttggttcaaaacgcagaaaacttccttgcgttaacccagcaggttgccggcactgccgggtctcatgtgggtcagccggacaccttgcaggtcagtggtgaagcattggtgcgtgagattggcgctcatgttgaaaccgctgacggaaggcgagttagcgtcggggcgttcccgatctcgattgatgttgaaatgtttggggaggcgtcgaaaagcgccgttcttgatcttttaaaaacgctcgacgagccggaaaccgtattcctgggcgttgaccgactggactacaccaagggcattttgcagcgcctgcttgcgtttgaggaactgctggaatccggcgcgttggaggccgacaaagctgtgttgctgcaggtcgcgacgccttcgcgtgagcgcattgatcactatcgtgtgtcgcgttcgcaggtcgaggaagccgtcggccgtatcaatggtcgtttcggtcgcatggggcgtcccgtggtgcattatctacacaggtcattgagcaaaaatgatctccaggtgctgtataccgcagccgatgtcatgctggttacgccttttaaagacggtatgaacttggtggctaaagaattcgtggccaaccaccgcgacggcactggtgctttggtgctgtccgaatttgccggcgcggccactgagctgaccggtgcgtatttatgcaacccatttgatgtggaatccatcaaacggcaaatggtggcagctgtccatgatttgaagcacaatccggaatctgcggcaacgcgaatgaaaacgaacagcgagcaggtctatacccacgacgtcaacgtgtgggctaatagtttcctggattgtttggcacagtcggga

SEQ ID NO: 20 - protein, 482 aa, Corynebacterium glutamicum
MDDSNSFVVVANRLPVDMTVHPDGSYSISPSPGGLVTGLSPVLEQHRGCWVGWPGTVDVAPEPFRTDTGVLLHPVVLTASDYEGFYEGFSNATLWPLFHDLIVTPVYNTDWWHAFREVNLKFAEAVSQVAAHGATVWVQDYQLLLVPGILRQMRPDLKIGFFLHIPFPSPDLFRQLPWREEIVRGMLGADLVGFHLVQNAENFLALTQQVAGTAGSHVGQPDTLQVSGEALVREIGAHVETADGRRVSVGAFPISIDVEMFGEASKSAVLDLLKTLDEPETVFLGVDRLDYTKGILQRLLAFEELLESGALEADKAVLLQVATPSRERIDHYRVSRSQVEEAVGRINGRFGRMGRPVVHYLHRSLSKNDLQVLYTAADVMLVTPFKDGMNLVAKEFVANHRDGTGALVLSEFAGAATELTGAYLCNPFDVESIKRQMVAAVHDLKHNPESAATRMKTNSEQVYTHDVNVWANSFLDCLAQSG

SEQ ID NO: 21 - DNA, 779 bp, Corynebacterium glutamicum
  CDS (1)..(756): RXA00873
actgcccaatggggtattttcctgcgtaatcatgatgagctcacccttgaaatggtctccgatgaggaacgcagctacatgtactcccaattcgcctccgaacctcgcatgcgcgccaacgtaggaatccgcaggcgcctttccccactgcttgaaggcgaccgcaaccagctggaactccttcacggtttgttgctgtctctacctggctcacccgtgttgtattacggtgatgaaattggcatgggcgacaatatctggctccacgaccgcgacggagtgcgcacccccatgcagtggtccaacgaccgcaacggtggtttctccaaagctgatcctgaacgcctgtaccttccagcgatccaaaatgatcaatacggctacgcccaagtaaacgtggaaagccaactcaaccgcgaaaactccctgctgcgctggctccgaaaccaaatccttatccgcaagcagtaccgcgcatttggtgccggaacctaccgtgaagtgtcctccaccaatgagtcagtgttgacatttttacgagaacacaagggccaaaccattttgtgtgtcaacaacatgagcaaatatcctcaggcagtctcgcttgatttgcgtgaatttgcaggacacacccctcgagagatgtcgggcgggcagctgttccctaccattgctgaacgggagtggattgtcactttagcccctcacggattcttctggtttgatctcaccgccgatgaaaaggacgatatggaatgagcattggccaacacatcatc

SEQ ID NO: 22 - protein, 252 aa, Corynebacterium glutamicum
TAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 23 - DNA, 1102 bp, Corynebacterium glutamicum
  CDS (101)..(1102): RXA00891
tcaatattccgaagaaaaccgcgcagctctctcactagtctcaggtgaggcgaaagtggtgaaagacccgctacgcatggtgcgcctggctttttagaatgtgctgcaaacctcctggcatttctctatcctggcaggcatgactgatacctctccgttgaattctcagccgagtgcagatcaccaccctgatcacgcggctcgcccagttcttgatgcccacggcttgatcgttgagcacgaatcggaagagtttccagtccccgcacccgctcccggtgaacagccctgggagaagaaaaaccgcgagtggtacaaagacgccgttttctacgaagtgctggttcgtgccttctacgatccagaaggcaacggagtcggatcgttgaaaggcctgaccgaaaaactggattacatccagtggctcggcgtggattgcatttggatcccaccgttttatgattccccactgcgcgacggcggttacgatatccgcaacttccgtgaaatcctgcccgaattcggcaccgtcgatgacttcgtggaactcgttgaccacgcccaccgccgtggcctgcgtgttatcaccgacttggtcatgaatcacacctccgaccagcacgcatggttccaagaatcccggcgcgacccaaccggcccctacggagatttctatgtgtggagcgatgatcccaccctgtacaacgaagcccgcatcatctttgtagatacagaagaatccaactggacctatgatccggtgcgtggccagtacttctggcaccgcttcttctcccaccaaccagacctcaactacgacaaccccgcagtccaagaggccatgctagatgtcttgcgtttctggctggacctgggacttgatggtttccgactagatgccgttccttatctttttgaacgcgaaggcaccaacggcgaaaacctcaaagaaacccacgatttcctcaaactgtgtcgctctgtcattgagaaggaataccccggccgaatcctgctcgcagaagccaaccaatggccccaagatgtggtcgaatacttcggtgaaaaagacaaaggcgatgaatgccacatggccttccac

SEQ ID NO: 24 - protein, 334 aa, Corynebacterium glutamicum
VLQTSWHFSILAGMTDTSPLNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFH

SEQ ID NO: 25 - DNA, 1386 bp, Corynebacterium glutamicum
  CDS (101)..(1363): RXA00534
ctgtgcagaaagaaaacactcctctggctaggtagacacagtttataaaggtagagttgagcgggtaactgtcagcacgtagatcgaaaggtgcacaaaggtggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagcccaatctttcacgggctctcaggctggtgtgctcaccaccgagcgccacggaaacgcacgcattgttgatgtcactccaggtcgtgtgcgtgaagcactcgatgagggcaagatctgcattgttgctggtttccagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgaggctgcgaaggttttccgtgcgttggctgatgcagaaatcaacattgacatggttctgcagaacgtctcttctgtagaagacggcaccaccgacatcaccttcacctgccctcgttccgacggccgccgcgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagattcgtatttccgtgctgatccgtgaagatgatctggatgctgctgcacgtgcattgcatgagcagttccagctgggcggcgaagacgaagccgtcgtttatgcaggcaccggacgctaaagttttaaaggagtagtttt

SEQ ID NO: 26 - protein, 421 aa, Corynebacterium glutamicum
VALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 27 - DNA, 1155 bp, Corynebacterium glutamicum
  CDS (101)..(1132): RXA00533
ctgcacgtgcattgcatgagcagttccagctgggcggcgaagacgaagccgtcgtttatgcaggcaccggacgctaaagttttaaaggagtagttttacaatgaccaccatcgcagttgttggtgcaaccggccaggtcggccaggttatgcgcacccttttggaagagcgcaatttcccagctgacactgttcgtttctttgcttccccacgttccgcaggccgtaagattgaattccgtggcacggaaatcgaggtagaagacattactcaggcaaccgaggagtccctcaaggacatcgacgttgcgttgttctccgctggaggcaccgcttccaagcagtacgctccactgttcgctgctgcaggcgcgactgttgtggataactcttctgcttggcgcaaggacgacgaggttccactaatcgtctctgaggtgaacccttccgacaaggattccctggtcaagggcattattgcgaaccctaactgcaccaccatggctgcgatgccagtgctgaagccacttcacgatgccgctggtcttgtaaagcttcacgtttcctcttaccaggctgtttccggttctggtcttgcaggtgtggaaaccttggcaaagcaggttgctgcagttggagaccacaacgttgagttcgtccatgatggacaggctgctgacgcaggcgatgtcggaccttatgtttcaccaatcgcttacaacgtgctgccattcgccggaaacctcgtcgatgacggcaccttcgaaaccgatgaagagcagaagctgcgcaacgaatcccgcaagattctcggtctcccagacctcaaggtctcaggcacctgcgtccgcgtgccggttttcaccggccacacgctgaccattcacgccgaattcgacaaggcaatcaccgtggaccaggcgcaggagatcttgggtgccgcttcaggcgtcaagcttgtcgacgtcccaaccccacttgcagctgccggcattgacgaatccctcgttggacgcatccgtcaggactccactgtcgacgataaccgcggtctggttctcgtcgtatctggcgacaacctccgcaagggtgctgcgctaaacaccatccagatcgctgagctgctggttaagtaaaaacccgccattaaaaactc

SEQ ID NO: 28 - protein, 344 aa, Corynebacterium glutamicum
MTTIAVVGATGQVGQVMRTLLEERNFPADTVRFFASPRSAGRKIEFRGTEIEVEDITQATEESLKDIDVALFSAGGTASKQYAPLFAAAGATVVDNSSAWRKDDEVPLIVSEVNPSDKDSLVKGIIANPNCTTMAAMPVLKPLHDAAGLVKLHVSSYQAVSGSGLAGVETLAKQVAAVGDHNVEFVHDGQAADAGDVGPYVSPIAYNVLPFAGNLVDDGTFETDEEQKLRNESRKILGLPDLKVSGTCVRVPVFTGHTLTIHAEFDKAITVDQAQEILGAASGVKLVDVPTPLAAAGIDESLVGRIRQDSTVDDNRGLVLVVSGDNLRKGAALNTIQIAELLVK

SEQ ID NO: 29 - DNA, 608 bp, Corynebacterium glutamicum
  CDS (69)..(608): RXA02843
cccattgcgcggaggtcgcaccccttccgacttgaactgataggccgatagaaattattctggacgtcatgactactgcttccgcaaccggaattgcaacactgacctccaccggcgacgtcctggacgtgtggtatccagaaatcgggtccaccgaccagtccgcgctcacacctctagaaggcgtcgatgaagatcgaaacgtcacccgcaaaatcgtgacgacaactatcgacaccgacgcagcccccaccgacacctacgatgcatggctgcgccttcacctcctctcccaccgcgttttccgccctcacaccatcaacctagacggcattttcggcctcctcaacaatgtcgtgtggaccaacttcggaccgtgcgcagttgacggtttcgcactcacccgcgcgcgcctgtcacgccgaggccaagttacggtttatagcgtcgacaagttcccacgcatggtcgactatgtggttccctcgggcgtgcgcatcggtgacgccgaccgcgtccgacttggcgcgtacctggcagatggcaccaccgtgatgcatgagggcttcgtgaacttcaacgctggcacgctcggcgcttccatggtt

SEQ ID NO: 30 - protein, 180 aa, Corynebacterium glutamicum
MTTASATGIATLTSTGDVLDVWYPEIGSTDQSALTPLEGVDEDRNVTRKIVTTTIDTDAAPTDTYDAWLRLHLLSHRVFRPHTINLDGIFGLLNNVVWTNFGPCAVDGFALTRARLSRRGQVTVYSVDKFPRMVDYVVPSGVRIGDADRVRLGAYLADGTTVMHEGFVNFNAGTLGASMV

SEQ ID NO: 31 - DNA, 1230 bp, Corynebacterium glutamicum
  CDS (101)..(1207): RXA02022
tatttgcgattccaactgcttgggctccgcgaatgttttcactcattttttaatcgaccgcttccatcatgttttaactaaggtttgtaggcttaaacctgtgaactctgaactcaaaccaggattagatctcctcggcgacccaattgtccttactcaacgtttggtagatataccgagtccgtcgggtcaggaaaagcagattgctgatgaaattgaagatgcccttcggaaccttaatctacctggtgtagaggtcttccgcttcaacaacaacgttcttgctcgcacgaacaggggattggcctcgagggtcatgcttgctggtcatatcgatacagtgccgatcgcggacaatctgccaagccgtgtggaagacggcatcatgtatggctgtggcaccgtcgatatgaaatctgggttggcggtgtatttgcatacttttgccaccttggccacgtcgactgagcttaaacatgatctgacgctgattgcgtatgagtgcgaggaagttgctgatcacctcaatggtttgggccacattcgcgatgagcatccggagtggttggcggctgatttggcgttgttgggtgagcctactggcggctggattgaggcgggctgccagggcaatctgcgcatcaaggtgacggcgcatggtgtgcgtgcccattcggcgagaagctggttgggtgataatgcgatgcataagttgtcgccgatcatttcgaaggttgctgcgtataaggccgcagaagtcaacattgatggcttgacctaccgtgaaggcctcaacatcgttttctgcgaatcgggcgtggcaaacaacgtcattccagacctcgcgtggatgaacctcaacttccgtttcgcgccgaatcgcgatctcaacgaggcgatcgagcatgtcgtcgaaacgcttgagcttgacggtcaagacggcatcgaatgggccgtagaagacggggcaggcggtgcccttccaggcttggggcagcaggtgacaagcgggcttatcgacgccgtcggccgcgaaaaaatccgcgcaaaattcggctggaccgatgtctcacgtttttcagccatgggaattccagccctaaactttggcgctggtgatccaagtttcgcgcataaacgcgacgagcagtgcccagtggagcaaatcacggatgtggcagcaattttgaagcagtacctgagcgagtaaccgcattcggggttatcgtg

SEQ ID NO: 32 - protein, 369 aa, Corynebacterium glutamicum
VNSELKPGLDLLGDPIVLTQRLVDIPSPSGQEKQIADEIEDALRNLNLPGVEVFRFNNNVLARTNRGLASRVMLAGHIDTVPIADNLPSRVEDGIMYGCGTVDMKSGLAVYLHTFATLATSTELKHDLTLIAYECEEVADHLNGLGHIRDEHPEWLAADLALLGEPTGGWIEAGCQGNLRIKVTAHGVRAHSARSWLGDNAMHKLSPIISKVAAYKAAEVNIDGLTYREGLNIVFCESGVANNVIPDLAWMNLNFRFAPNRDLNEAIEHVVETLELDGQDGIEWAVEDGAGGALPGLGQQVTSGLIDAVGREKIRAKFGWTDVSRFSAMGIPALNFGAGDPSFAHKRDEQCPVEQITDVAAILKQYLSE

SEQ ID NO: 33 - DNA, 1059 bp, Corynebacterium glutamicum
  CDS (101)..(1036): RXA00044
attacctcagccttccaagctgatgatgcattacttaaaaactgcagacacttgaaaaacttctcacccgcactcgttccctcaacccacaaggagcaccatggcttccgcaactttcaccggcgtgatcccacccgtaatgaccccactccacgccgacggcagtgtggatgtagaaagcctccgcaagctcgttgaccacctcatcaatggtggcgtcgacggacttttcgcactgggctcctcaggcgaagcggcattcctcacccgcgcccagcgcaaactcgcactgaccaccatcatcgagcacaccgcaggccgcgttcccgtaactgctggtgtcattgaaaccaccactgctcgcgtgattgagctcgtggaagatgccctggaggctggtgccgaaggcctcgttgccactgcacctttctacacccgcacccacgatgtggaaattgaagaacacttccgcaagatccacgccgccgctccagagcttccactgtttgcctacaacatcccagtgtcggtgcactccaacctcaacccagtcatgcttttgacgctggccaaggatggcgttcttgcaggcaccaaggattccagtggcaatgatggcgcaatccgctcactgatcgaagctcgtgatgatgctggactcactgagcagttcaagatcctcaccggcagcgaaaccaccgttgatttcgcctaccttgcgggtgccgatggagttgtcccaggcctgggcaatgttgatcctgcagcatacgcagctttagcaaaactctgcctcgatggaaagtgggcagaagctgctgctttgcagaagcgcatcaaccacctcttccacatcgtcttcgtgggagacacctcccatatgtccggatccagcgctggtttgggcggtttcaagacagcactcgcacaccttggcattattgaatccaatgcgatggcagttcctcaccagagcctcagcgacgaagaaactgctcgcattcacgccattgttgatgaattcctgtacaccgcttaaggcccacacctcatgactga

SEQ ID NO: 34 - protein, 312 aa, Corynebacterium glutamicum
MASATFTGVIPPVMTPLHADGSVDVESLRKLVDHLINGGVDGLFALGSSGEAAFLTRAQRKLALTTIIEHTAGRVPVTAGVIETTTARVIELVEDALEAGAEGLVATAPFYTRTHDVEIEEHFRKIHAAAPELPLFAYNIPVSVHSNLNPVMLLTLAKDGVLAGTKDSSGNDGAIRSLIEARDDAGLTEQFKILTGSETTVDFAYLAGADGVVPGLGNVDPAAYAALAKLCLDGKWAEAAALQKRINHLFHIVFVGDTSHMSGSSAGLGGFKTALAHLGIIESNAMAVPHQSLSDEETARIHAIVDEFLYTA

SEQ ID NO: 35 - DNA, 867 bp, Corynebacterium glutamicum
  CDS (101)..(844): RXA00863
aacggtcagttaggtatggatatcagcaccttctgaacgggtacgtctagactggtgggcgtttgaaaaactcttcgccccacgaaaatgaaggagcataatgggaatcaaggttggcgttctcggagccaaaggccgtgttggtcaaactattgtggcagcagtcaatgagtccgacgatctggagcttgttgcagagatcggcgtcgacgatgatttgagccttctggtagacaacggcgctgaagttgtcgttgacttcaccactcctaacgctgtgatgggcaacctggagttctgcatcaacaacggcatttctgcggttgttggaaccacgggcttcgatgatgctcgtttggagcaggttcgcgactggcttgaaggaaaagacaatgtcggtgttctgatcgcacctaactttgctatctctgcggtgttgaccatggtcttttccaagcaggctgcccgcttcttcgaatcagctgaagttattgagctgcaccaccccaacaagctggatgcaccttcaggcaccgcgatccacactgctcagggcattgctgcggcacgcaaagaagcaggcatggacgcacagccagatgcgaccgagcaggcacttgagggttcccgtggcgcaagcgtagatggaatcccggttcatgcagtccgcatgtccggcatggttgctcacgagcaagttatctttggcacccagggtcagaccttgaccatcaagcaggactcctatgatcgcaactcatttgcaccaggtgtcttggtgggtgtgcgcaacattgcacagcacccaggcctagtcgtaggacttgagcattacctaggcctgtaaaggctcatttcagcagcggg

SEQ ID NO: 36 - protein, 248 aa, Corynebacterium glutamicum
MGIKVGVLGAKGRVGQTIVAAVNESDDLELVAEIGVDDDLSLLVDNGAEVVVDFTTPNAVMGNLEFCINNGISAVVGTTGFDDARLEQVRDWLEGKDNVGVLIAPNFAISAVLTMVFSKQAARFFESAEVIELHHPNKLDAPSGTAIHTAQGIAAARKEAGMDAQPDATEQALEGSRGASVDGIPVHAVRMSGMVAHEQVIFGTQGQTLTIKQDSYDRNSFAPGVLVGVRNIAQHPGLVVGLEHYLGL

SEQ ID NO: 37 - DNA, 873 bp, Corynebacterium glutamicum
  CDS (101)..(850): RXA00864
acagcacccaggcctagtcgtaggacttgagcattacctaggcctgtaaaggctcatttcagcagcgggtggaattttttaaaaggagcgtttaaaggctgtggccgaacaagttaaattgagcgtggagttgatagcgtgcagttcttttactccacccgctgatgttgagtggtcaactgatgttgagggcgcggaagcactcgtcgagtttgcgggtcgtgcctgctacgaaacttttgataagccgaaccctcgaactgcttccaatgctgcgtatctgcgccacatcatggaagtggggcacactgctttgcttgagcatgccaatgccacgatgtatatccgaggcatttctcggtccgcgacccatgaattggtccgacaccgccatttttccttctctcaactgtctcagcgtttcgtgcacagcggagaatcggaagtagtggtgcccactctcatcgatgaagatccgcagttgcgtgaacttttcatgcacgccatggatgagtctcggttcgctttcaatgagctgcttaatgcgctggaagaaaaacttggcgatgaaccgaatgcacttttaaggaaaaagcaggctcgtcaagcagctcgcgctgtgctgcccaacgctacagagtccagaatcgtggtgtctggaaacttccgcacctggaggcatttcattggcatgcgagccagtgaacatgcagacgtcgaaatccgcgaagtagcggtagaatgtttaagaaagctgcaggtagcagcgccaactgttttcggtgattttgagattgaaactttggcagacggatcgcaaatggcaacaagcccgtatgtcatggacttttaacgcaaagctcacacccacga

SEQ ID NO: 38 - protein, 250 aa, Corynebacterium glutamicum
VAEQVKLSVELIACSSFTPPADVEWSTDVEGAEALVEFAGRACYETFDKPNPRTASNAAYLRHIMEVGHTALLEHANATMYIRGISRSATHELVRHRHFSFSQLSQRFVHSGESEVVVPTLIDEDPQLRELFMHAMDESRFAFNELLNALEEKLGDEPNALLRKKQARQAARAVLPNATESRIVVSGNFRTWRHFIGMRASEHADVEIREVAVECLRKLQVAAPTVFGDFEIETLADGSQMATSPYVMDF

SEQ ID NO: 39 - DNA, 608 bp, Corynebacterium glutamicum; identical to SEQ ID NO: 29
  CDS (69)..(608): RXA02843

SEQ ID NO: 40 - protein, 180 aa, Corynebacterium glutamicum; identical to SEQ ID NO: 30

SEQ ID NO: 41 - DNA, 1143 bp, Corynebacterium glutamicum
  CDS (101)..(1120): RXN00355
aatagatcagcgcatccgtggtggaaccaaaaggctcaacaatacgaaacgttcgctttcggtcctgatgaaagagatgtccctgaatcatcatctaagtatgcatctcggtaagctcgaccaggacagtgccaccacaattttggaggattacaagaacatgaccaacatccgcgtagctatcgtgggctacggaaacctgggacgcagcgtcgaaaagcttattgccaagcagcccgacatggaccttgtaggaatcttctcgcgccgggccaccctcgacacaaagacgccagtctttgatgtcgccgacgtggacaagcacgccgacgacgtggacgtgctgttcctgtgcatgggctccgccaccgacatccctgagcaggcaccaaagttcgcgcagttcgcctgcaccgtagacacctacgacaaccaccgcgacatcccacgccaccgccaggtcatgaacgaagccgccaccgcagccggcaacgttgcactggtctctaccggctgggatccaggaatgttctccatcaaccgcgtctacgcagcggcagtcttagccgagcaccagcagcacaccttctggggcccaggtttgtcacagggccactccgatgctttgcgacgcatccctggcgttcaaaaggcagtccagtacaccctcccatccgaagacgccctggaaaaggcccgccgcggcgaagccggcgaccttaccggaaagcaaacccacaagcgccaatgcttcgtggttgccgacgcggccgatcacgagcgcatcgaaaacgacatccgcaccatgcctgattacttcgttggctacgaagtcgaagtcaacttcatcgacgaagcaaccttcgactccgagcacaccggcatgccacacggtggccacgtgattaccaccggcgacaccggtggcttcaaccacaccgtggaatacatcctcaagctggaccgaaacccagatttcaccgcttcctcacagatcgctttcggtcgcgcagctcaccgcatgaagcagcagggccaaagcggagctttcaccgtcctcgaagttgctccatacctgctctccccagagaacttggacgatctgatcgcacgcgacgtctaatttagctcgaggggcaagga

SEQ ID NO: 42 - protein, 340 aa, Corynebacterium glutamicum
MHLGKLDQDSATTILEDYKNMTNIRVAIVGYGNLGRSVEKLIAKQPDMDLVGIFSRRATLDTKTPVFDVADVDKHADDVDVLFLCMGSATDIPEQAPKFAQFACTVDTYDNHRDIPRHRQVMNEAATAAGNVALVSTGWDPGMFSINRVYAAAVLAEHQQHTFWGPGLSQGHSDALRRIPGVQKAVQYTLPSEDALEKARRGEAGDLTGKQTHKRQCFVVADAADHERIENDIRTMPDYFVGYEVEVNFIDEATFDSEHTGMPHGGHVITTGDTGGFNHTVEYILKLDRNPDFTASSQIAFGRAAHRMKQQGQSGAFTVLEVAPYLLSPENLDDLIARDV

SEQ ID NO: 43 - DNA, 958 bp, Corynebacterium glutamicum
  CDS (101)..(958): FRXA00352
aatagatcagcgcatccgtggtggaaccaaaaggctcaacaatacgaaacgttcgctttcggtcctgatgaaagagatgtccctgaatcatcatctaagtatgcatctcggtaagctcgaccaggacagtgccaccacaattttggaggattacaagaacatgaccaacatccgcgtagctatcgtgggctacggaaacctgggacgcagcgtcgaaaagcttattgccaagcagcccgacatggaccttgtaggaatcttctcgcgccgggccaccctcgacacaaagacgccagtctttgatgtcgccgacgtggacaagcacgccgacgacgtggacgtgctgttcctgtgcatgggctccgccaccgacatccctgagcaggcaccaaagttcgcgcagttcgcctgcaccgtagacacctacgacaaccaccgcgacatcccacgccaccgccaggtcatgaacgaagccgccaccgcagccggcaacgttgcactggtctctaccggctgggatccaggaatgttctccatcaaccgcgtctacgcagcggcagtcttagccgagcaccagcagcacaccttctggggcccaggtttgtcacagggccactccgatgctttgcgacgcatccctggcgttcaaaaggcagtccagtacaccctcccatccgaagacgccctggaaaaggcccgccgcggcgaagccggcgaccttaccggaaagcaaacccacaagcgccaatgcttcgtggttgccgacgcggccgatcacgagcgcatcgaaaacgacatccgcaccatgcctgattacttcgttggctacgaagtcgaagtcaacttcatcgacgaagcaaccttcgactccgagcacaccggcatgccacacggtggccacgtgattaccaccggcgacaccggtggcttcaaccacaccgtggaatacatcctcaag

SEQ ID NO: 44 - protein, 286 aa, Corynebacterium glutamicum
MHLGKLDQDSATTILEDYKNMTNIRVAIVGYGNLGRSVEKLIAKQPDMDLVGIFSRRATLDTKTPVFDVADVDKHADDVDVLFLCMGSATDIPEQAPKFAQFACTVDTYDNHRDIPRHRQVMNEAATAAGNVALVSTGWDPGMFSINRVYAAAVLAEHQQHTFWGPGLSQGHSDALRRIPGVQKAVQYTLPSEDALEKARRGEAGDLTGKQTHKRQCFVVADAADHERIENDIRTMPDYFVGYEVEVNFIDEATFDSEHTGMPHGGHVITTGDTGGFNHTVEYILK

SEQ ID NO: 45 - DNA, 1400 bp, Corynebacterium glutamicum
  CDS (1)..(1377): RXA00972
cctgcacctggttggcgtttccgcaccggagaagatgtaacaatggctacagttgaaaatttcaatgaacttcccgcacacgtatggccacgcaatgccgtgcgccaagaagacggcgttgtcaccgtcgctggtgtgcctctgcctgacctcgctgaagaatacggaaccccactgttcgtagtcgacgaggacgatttccgttcccgctgtcgcgacatggctaccgcattcggtggaccaggcaatgtgcactacgcatctaaagcgttcctgaccaagaccattgcacgttgggttgatgaagaggggctggcactggacattgcatccatcaacgaactgggcattgccctggccgctggtttccccgccagccgtatcaccgcgcacggcaacaacaaaggcgtagagttcctgcgcgcgttggttcaaaacggtgtgggacacgtggtgctggactccgcacaggaactagaactgttggattacgttgccgctggtgaaggcaagattcaggacgtgttgatccgcgtaaagccaggcatcgaagcacacacccacgagttcatcgccactagccacgaagaccagaagttcggattctccctggcatccggttccgcattcgaagcagcaaaagccgccaacaacgcagaaaacctgaacctggttggcctgcactgccacgttggttcccaggtgttcgacgccgaaggcttcaagctggcagcagaacgcgtgttgggcctgtactcacagatccacagcgaactgggcgttgcccttcctgaactggatctcggtggcggatacggcattgcctataccgcagctgaagaaccactcaacgtcgcagaagttgcctccgacctgctcaccgcagtcggaaaaatggcagcggaactaggcatcgacgcaccaaccgtgcttgttgagcccggccgcgctatcgcaggcccctccaccgtgaccatctacgaagtcggcaccaccaaagacgtccacgtagacgacgacaaaacccgccgttacatcgccgtggacggaggcatgtccgacaacatccgcccagcactctacgggtccgaatacgacgcccgcgtagtatcccgcttcgccgaaggagacccagtaagcacccgcatcgtgggctcccactgcgaatccggcgatatcctgatcaacgatgaaatctacccatctgacatcaccagcggcgacttccttgcactcgcagccaccggcgcatactgctacgccatgagctcccgctacaacgccttcacacggcccgccgtcgtgtccgtccgcgctggcagctcccgcctcatgctgcgccgcgaaacgctcgacgacatcctctcactagaggcataacgcttttcgacgcctgaccc

SEQ ID NO: 46 - protein, 459 aa, Corynebacterium glutamicum
PAPGWRFRTGEDVTMATVENFNELPAHVWPRNAVRQEDGVVTVAGVPLPDLAEEYGTPLFVVDEDDFRSRCRDMATAFGGPGNVHYASKAFLTKTIARWVDEEGLALDIASINELGIALAAGFPASRITAHGNNKGVEFLRALVQNGVGHVVLDSAQELELLDYVAAGEGKIQDVLIRVKPGIEAHTHEFIATSHEDQKFGFSLASGSAFEAAKAANNAENLNLVGLHCHVGSQVFDAEGFKLAAERVLGLYSQIHSELGVALPELDLGGGYGIAYTAAEEPLNVAEVASDLLTAVGKMAAELGIDAPTVLVEPGRAIAGPSTVTIYEVGTTKDVHVDDDKTRRYIAVDGGMSDNIRPALYGSEYDARVVSRFAEGDPVSTRIVGSHCESGDILINDEIYPSDITSGDFLALAATGAYCYAMSSRYNAFTRPAVVSVRAGSSRLMLRRETLDDILSLEA

SEQ ID NO: 47 - DNA, 2121 bp, Corynebacterium glutamicum
  CDS (101)..(2098): RXA02653
agacagagtgttagtgcgtggggcagctctcactttcatcgacatcactcgagtatgctcaccggccgtattcattccaataacccgcacagggaaactaatgataccgaagcccgacgtgaccgacttatatttagaggacctcttaaatgagggttcggaaaagattcggtccgccaaggatctttccgaacttaggacagttctaaaagaggtttcctcccaaattcaggaacgagctgggaaaaaagatgaagaatggggaatgggggccacttggcgggagctgtaccccagcatcgtggaacgcgcttcctacgaagggcgtgacagcctaatcggatttgatcacttagcccgggaaatggaaagattagccttcggcccaccatccgaaagttttgaatacctccaagaactcgtaaaatccggagtggtagacatcactcacctgcatcgtggccgggaaccactgacagatttagttcgtgaacttgaaataactgtggtgatagacgctgttcttcccccgccgggagtagtgccaggcacattggtgcacaatttggtaaaagagggatatgccagaatgcgtcctgggactcgggggttagatgtagcggctgacggcaccgttcaagggcaacgacatttggctgcagtcggacggatgacggaagatgtggttttgggtaatgacacattgtcgcgatcattacatgacataatcccgaagtgggctcgtcgagttatccgcgacgcgagcacgtatcccgatagggtacatggtactccaccgcttccggcacggttggaaccctgggcggaaaagctcacttcagatccggccacatgccgccacctgattgaagaattcgggagtcctgtgaatgtactccattcaggttctatgcctcgtaatataaatgagttggttgacgccggcattcagatgggggtggatactcgaatattttttgcccgcaaagcgaataagggtcttaccttcgttgatgccgttaaagacaccggtcatggtgtagatgtagccagtgaacgagagttatctcaggtgcttaatcgtggagtcccaggagagcggatcattctatccgcagctatcaaaccggacagactattggcattagcgatcgaaaatggcgtgatcatctctgtggattcgcgtgatgaattagatcgcatttcggctttggttggtgaccgcgttgcacgagttgcgcctagagtagctccagatcctgcagtcttacctccaactagatttggtgagcgtgctgcagactggggtaatcggcttaccgaggtgatacccggcgtggatattgtgggtcttcacgttcacctccatggctatgctgcaaaagaccgtgctctggctctgcaggaatgttgccaactcgtcgattctctcagagaatgcgggcattccccacagtttattgaccttggaggaggggtgcctatgagctacattgaatctgaggaagattggatccgttatcaatccgctaaatctgcgacttcagccgggtatgccgaatcctttacgtggaaagacgatccgttatctaatacgtacccgttctatcagaccccagtgcgcggtaattggttgaaagacgtgctttctaagggggtagctcagatgctcattgaccggggattgcggttacacatagagcctggtcgaagtttactagatgggtgtggcgtcactcttgccgaagttgcttttgtgaaaacccgaagtgacgggttgcctctagtgggactggctatgaaccgaacgcagtgccggactacatccgatgattttctcattgatcccctgcatatcactgacggtgatgtaggcgaggaaatcgaagcatatctagtgggtgcctactgcatcgaagatgagctgattttacgccggcgaatccgcttcccgagaggagtcaaaccaggagatatcatcggaattcctaacaccgcaggatacttcatgcatatcttggaaagtgcatcgcaccaaatcccgttggcgaaaaatgtagtgtggccggaggggcagttagacgatatcgatgcggattaagacataaccattcgctaatc

SEQ ID NO: 48 - protein, 666 aa, Corynebacterium glutamicum
MIPKPDVTDLYLEDLLNEGSEKIRSAKDLSELRTVLKEVSSQIQERAGKKDEEWGMGATWRELYPSIVERASYEGRDSLIGFDHLAREMERLAFGPPSESFEYLQELVKSGVVDITHLHRGREPLTDLVRELEITVVIDAVLPPPGVVPGTLVHNLVKEGYARMRPGTRGLDVAADGTVQGQRHLAAVGRMTEDVVLGNDTLSRSLHDIIPKWARRVIRDASTYPDRVHGTPPLPARLEPWAEKLTSDPATCRHLIEEFGSPVNVLHSGSMPRNINELVDAGIQMGVDTRIFFARKANKGLTFVDAVKDTGHGVDVASERELSQVLNRGVPGERIILSAAIKPDRLLALAIENGVIISVDSRDELDRISALVGDRVARVAPRVAPDPAVLPPTRFGERAADWGNRLTEVIPGVDIVGLHVHLHGYAAKDRALALQECCQLVDSLRECGHSPQFIDLGGGVPMSYIESEEDWIRYQSAKSATSAGYAESFTWKDDPLSNTYPFYQTPVRGNWLKDVLSKGVAQMLIDRGLRLHIEPGRSLLDGCGVTLAEVAFVKTRSDGLPLVGLAMNRTQCRTTSDDFLIDPLHITDGDVGEEIEAYLVGAYCIEDELILRRRIRFPRGVKPGDIIGIPNTAGYFMHILESASHQIPLAKNVVWPEGQLDDIDAD

SEQ ID NO: 49 - DNA, 993 bp, Corynebacterium glutamicum
  CDS (101)..(970): RXA01393
caaaagcagacctgtaatgaagatttccatgatcaccatcgtgacctatggaagtacttaagtaaaatgattggttcttaacatggtttaatatagcttcatgaaccccattcaactggacactttgctctcaatcattgatgaaggcagcttcgaaggcgcctccttagccctttccatttccccctcggcggtgagtcagcgcgttaaagctctcgagcatcacgtgggtcgagtgttggtatcgcgcacccaaccggccaaagcaaccgaagcgggtgaagtccttgtgcaagcagcgcggaaaatggtgttgctgcaagcagaaactaaagcgcaactatctggacgccttgctgaaatcccgttaaccatcgccatcaacgcagattcgctatccacatggtttcctcccgtgttcaacgaggtagcttcttggggtggagcaacgctcacgctgcgcttggaagatgaagcgcacacattatccttgctgcggcgtggagatgttttaggagcggtaacccgtgaagctaatcccgtggcgggatgtgaagtagtagaacttggaaccatgcgccacttggccattgcaaccccctcattgcgggatgcctacatggttgatgggaaactagattgggctgcgatgcccgtcttacgcttcggtcccaaagatgtgcttcaagaccgtgacctggacgggcgcgtcgatggtcctgtggggcgcaggcgcgtatccattgtcccgtcggcggaaggttttggtgaggcaattcgccgaggccttggttggggacttcttcccgaaacccaagctgctcccatgctaaaagcaggagaagtgatcctcctcgatgagatacccattgacacaccgatgtattggcaacgatggcgcctggaatctagatctctagctagactcacagacgccgtcgttgatgcagcaatcgagggattgcggccttagttacttctgaaaaggttcag

SEQ ID NO: 50 - protein, 290 aa, Corynebacterium glutamicum
MNPIQLDTLLSIIDEGSFEGASLALSISPSAVSQRVKALEHHVGRVLVSRTQPAKATEAGEVLVQAARKMVLLQAETKAQLSGRLAEIPLTIAINADSLSTWFPPVFNEVASWGGATLTLRLEDEAHTLSLLRRGDVLGAVTREANPVAGCEVVELGTMRHLAIATPSLRDAYMVDGKLDWAAMPVLRFGPKDVLQDRDLDGRVDGPVGRRRVSIVPSAEGFGEAIRRGLGWGLLPETQAAPMLKAGEVILLDEIPIDTPMYWQRWRLESRSLARLTDAVVDAAIEGLRP

SEQ ID NO: 51 - DNA, 1626 bp, Corynebacterium glutamicum
  CDS (101)..(1603): RXA00241
ggtctccagcctttctaaacaattcatctgcacttgattaattggccccaagattacgcgaagtttagcgacttcgccgtacgtcaactacgttaaatgagtgaatactcaatcagattctgcggggtctcaaggtgcagcggccacaagtcgtactgtatctattagaaccctcatcgcgctgatcatcggatcgaccgtcggcgcgggaattttctccatccctcaaaacatcggctcagtcgcaggtcccggcgcgatgctcatcggctggctgatcgccggtgtgggcatgttgtccgtagcgttcgtgttccatgttcttgcccgccgtaaacctcacctcgattctggcgtctacgcatatgcgcgtgttggattgggcgattatgtaggtttctcctccgcttggggttattggctgggttcagtcatcgcccaagttggctacgcaacgttatttttctccacgttgggccactacgtaccgctgttttcccaagatcatccatttgtgtcagcgttggcagttagcgctttgacctggctggtgtttggagttgtttcccgaggaattagccaagctgctttcttgacaacggtcaccaccgtggccaaaattctgcctctgttgtgcttcatcatccttgttgcattcttgggctttagctgggagaagttcactgttgatttatgggcgcgtgatggtggcgtgggcagcatttttgatcaggtgcgcggcatcatggtgtacaccgtgtgggtgttcatcggtatcgaaggtgcatcggtatattcccgccaggcacgctcacgcagtgatgtcagccgagctaccgtgattggttttgtggctgttctccttttgctggtgtcgatttcttcgctgagcttcggtgtactgacccaacaagagctcgctgcgttaccagataattccatggcgtcggtgctcgaagctgttgttggtccatggggtgccgcattgatttcgttgggtctgtgtctttcggttcttggggcctatgtgtcctggcagatgctctgcgcagaaccactggcgttgatggcaatggatggcctcattccaagcaaaatcggggccatcaacagccgcggtgctgcctggatggctcagctgatctccaccatcgtgattcagattttcatcatcattttcttcctcaacgagaccacctacgtctccatggtgcaattggctaccaacctatacttggtgccttacctgttctctgccttttatctggtcatgctggcaacacgtggaaaaggaatcacccacccacatgccggcacacgttttgatgattccggtccagagatatcccgccgagaaaaccgcaaacacctcatcgtcggtttagtagcaacggtgtattcagtgtggctgttttacgctgcagaaccgcagtttgtcctcttcggagccatggcgatgcttcccggcttaatcccctatgtgtggacaaggatttatcgtggcgaacaggtgtttaaccgctttgaaatcggcgtggttgttgtcctggtcgttgctgccagcgcgggcgttattggtttggtcaacggatcactatcgctttaaacaccgaaaccttcctgcta

SEQ ID NO: 52 - protein, 501 aa, Corynebacterium glutamicum
VNTQSDSAGSQGAAATSRTVSIRTLIALIIGSTVGAGIFSIPQNIGSVAGPGAMLIGWLIAGVGMLSVAFVFHVLARRKPHLDSGVYAYARVGLGDYVGFSSAWGYWLGSVIAQVGYATLFFSTLGHYVPLFSQDHPFVSALAVSALTWLVFGVVSRGISQAAFLTTVTTVAKILPLLCFIILVAFLGFSWEKFTVDLWARDGGVGSIFDQVRGIMVYTVWVFIGIEGASVYSRQARSRSDVSRATVIGFVAVLLLLVSISSLSFGVLTQQELAALPDNSMASVLEAVVGPWGAALISLGLCLSVLGAYVSWQMLCAEPLALMAMDGLIPSKIGAINSRGAAWMAQLISTIVIQIFIIIFFLNETTYVSMVQLATNLYLVPYLFSAFYLVMLATRGKGITHPHAGTRFDDSGPEISRRENRKHLIVGLVATVYSVWLFYAAEPQFVLFGAMAMLPGLIPYVWTRIYRGEQVFNRFEIGVVVVLVVAASAGVIGLVNGSLSL

SEQ ID NO: 53 - DNA, 822 bp, Corynebacterium glutamicum
  CDS (101)..(799): RXA01394
gagcaaagtgtccagttgaatggggttcatgaagctatattaaaccatgttaagaaccaatcattttacttaagtacttccataggtcacgatggtgatcatggaaatcttcattacaggtctgcttttgggggccagtcttttactgtccatcggaccgcagaatgtactggtgattaaacaaggaattaagcgcgaaggactcattgcggttcttctcgtgtgtttaatttctgacgtctttttgttcatcgccggcaccttgggcgttgatcttttgtccaatgccgcgccgatcgtgctcgatattatgcgctggggtggcatcgcttacctgttatggtttgccgtcatggcagcgaaagacgccatgacaaacaaggtggaagcgccacagatcattgaagaaacagaaccaaccgtgcccgatgacacgcctttgggcggttcggcggtggccactgacacgcgcaaccgggtgcgggtggaggtgagcgtcgataagcagcgggtttgggtaaagcccatgttgatggcaatcgtgctgacctggttgaacccgaatgcgtatttggacgcgtttgtgtttatcggcggcgtcggcgcgcaatacggcgacaccggacggtggattttcgccgctggcgcgttcgcggcaagcctgatctggttcccgctggtgggtttcggcgcagcagcattgtcacgcccgctgtccagccccaaggtgtggcgctggatcaacgtcgtcgtggcagttgtgatgaccgcattggccatcaaactgatgttgatgggttagttttcgcgggttttggaatc

SEQ ID NO: 54 - protein, 233 aa, Corynebacterium glutamicum
MEIFITGLLLGASLLLSIGPQNVLVIKQGIKREGLIAVLLVCLISDVFLFIAGTLGVDLLSNAAPIVLDIMRWGGIAYLLWFAVMAAKDAMTNKVEAPQIIEETEPTVPDDTPLGGSAVATDTRNRVRVEVSVDKQRVWVKPMLMAIVLTWLNPNAYLDAFVFIGGVGAQYGDTGRWIFAAGAFAASLIWFPLVGFGAAALSRPLSSPKVWRWINVVVAVVMTALAIKLMLMG

SEQ ID NO: 55 - DNA, 1026 bp, Corynebacterium glutamicum
  CDS (101)..(1003): RXA00865
ttatcggaatgtggcttgggcgattgttatgcaaaagttgttaggttttttgcggggttgtttaacccccaaatgagggaagaaggtaaccttgaactctatgagcacaggtttaacagctaagaccggagtagagcacttcggcaccgttggagtagcaatggttactccattcacggaatccggagacatcgatatcgctgctggccgcgaagtcgcggcttatttggttgataagggcttggattctttggttctcgcgggcaccactggtgaatccccaacgacaaccgccgctgaaaaactagaactgctcaaggccgttcgtgaggaagttggggatcgggcgaagctcatcgccggtgtcggaaccaacaacacgcggacatctgtggaacttgcggaagctgctgcttctgctggcgcagacggccttttagttgtaactccttattactccaagccgagccaagagggattgctggcgcacttcggtgcaattgctgcagcaacagaggttccaatttgtctctatgacattcctggtcggtcaggtattccaattgagtctgataccatgagacgcctgagtgaattacctacgattttggcggtcaaggacgccaagggtgacctcgttgcagccacgtcattgatcaaagaaacgggacttgcctggtattcaggcgatgacccactaaaccttgtttggcttgctttgggcggatcaggtttcatttccgtaattggacatgcagcccccacagcattacgtgagttgtacacaagcttcgaggaaggcgacctcgtccgtgcgcgggaaatcaacgccaaactatcaccgctggtagctgcccaaggtcgcttgggtggagtcagcttggcaaaagctgctctgcgtctgcagggcatcaacgtaggagatcctcgacttccaattatggctccaaatgagcaggaacttgaggctctccgagaagacatgaaaaaagctggagttctataaatatgaatgattcccgaaat

SEQ ID NO: 56 - protein, 301 aa, Corynebacterium glutamicum
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAALRLQGINVGDPRLPIMAPNEQELEALREDMKKAGVL

SEQ ID NO: 57 - DNA, 1071 bp, Corynebacterium glutamicum
  CDS (101)..(1048): RXS02021
ttgggtcgccgaggagatctaatcctggtttgagttcagagttcacaggtttaagcctacaaaccttagttaaaacatgatggaagcggtcgattaaaaaatgagtgaaaacattcgcggagcccaagcagttggaatcgcaaatatcgccatggacgggaccatcctggacacgtggtacccagaaccccaaattttcaacccggatcagtgggctgaacgctacccattggaagtgggcaccacacgcctcggagcaaacgaactcaccccacggatgctgcagttggtaaaactggaccaagatcgcctcgtcgaacaggtagcagtccgcaccgttatccccgatctgtctcaacctccagtagacgcgcacgatgtttacctgcgcctccacctgctttcccaccggctggtccgcccccacgaaatgcacatgcaaaacaccttggagctgctgtccgacgtggtgtggacaaacaagggcccttgccttcctgaaaactttgagtgggtgcgtggtgctctgcggtcccgcggactcatccacgtctactgtgtggaccgtcttccccgcatggtcgactatgtggttccccctggagtccgcatctccgaagcagaacgcgtgcgcctaggtgcataccttgctccgggtacctctgtgctgcgtgaaggtttcgtgtctttcaactccggcaccttgggtgccgcaaaggtggaaggccgcctgagttccggtgtggtcatcggtgaaggttccgagattggactgtcttctactattcagtccccgagagatgaacagcgccgccgtttgccgttgagcatcggccaaaactgcaactttggtgtcagctccggaatcatcggagtcagtctgggagacaattgcgacatcggaaataacattgtcttggatggagatacccccatttggttcgcagccgatgaggagttacgcactatcgactccatcgaaggccaagcaaattggtcaatcaagcgtgaatccggcttccatgagccagttgcccgcctcaaagcttgacccattttcataaccagtgc

SEQ ID NO: 58 - protein, 316 aa, Corynebacterium glutamicum
MSENIRGAQAVGIANIAMDGTILDTWYPEPQIFNPDQWAERYPLEVGTTRLGANELTPRMLQLVKLDQDRLVEQVAVRTVIPDLSQPPVDAHDVYLRLHLLSHRLVRPHEMHMQNTLELLSDVVWTNKGPCLPENFEWVRGALRSRGLIHVYCVDRLPRMVDYVVPPGVRISEAERVRLGAYLAPGTSVLREGFVSFNSGTLGAAKVEGRLSSGVVIGEGSEIGLSSTIQSPRDEQRRRLPLSIGQNCNFGVSSGIIGVSLGDNCDIGNNIVLDGDTPIWFAADEELRTIDSIEGQANWSIKRESGFHEPVARLKA

SEQ ID NO: 59 - DNA, 1296 bp, Corynebacterium glutamicum
  CDS (101)..(1273): RXS02157
gggtggaattggcacgatggtgctgccggatgtttttgatcgggagaattatcctgaaggcaccgtttttagaaaagacgacaaggatggggaactgtaaatgagcacgctggaaacttggccacaggtcattattaatacgtacggcaccccaccagttgagctggtgtccggcaagggcgcaaccgtcactgatgaccagggcaatgtctacatcgacttgctcgcgggcatcgcagtcaacgcgttgggccacgcccacccggcgatcatcgaggcggtcaccaaccagatcggccaacttggtcacgtctcaaacttgttcgcatccaggcccgtcgtcgaggtcgccgaggagctcatcaagcgtttttcgcttgacgacgccaccctcgccgcgcaaacccgggttttcttctgcaactcgggcgccgaagcaaacgaggctgctttcaagattgcacgcttgactggtcgttcccggattctggctgcagttcatggtttccacggccgcaccatgggttccctcgcgctgactggccagccagacaagcgtgaagcgttcctgccaatgccaagcggtgtggagttctacccttacggcgacaccgattacttgcgcaaaatggtagaaaccaacccaacggatgtggctgctatcttcctcgagccaatccagggtgaaacgggcgttgttccagcacctgaaggattcctcaaggcagtgcgcgagctgtgcgatgagtacggcatcttgatgatcaccgatgaagtccagactggcgttggccgtaccggcgatttctttgcacatcagcacgatggcgttgttcccgatgtggtgaccatggccaagggacttggcggcggtcttcccatcggtgcttgtttggccactggccgtgcagctgaattgatgaccccaggcaagcacggcaccactttcggtggcaacccagttgcttgtgcagctgccaaggcagtgctgtctgttgtcgatgacgctttctgcgcagaagttgcccgcaagggcgagctgttcaaggaacttcttgccaaggttgacggcgttgtagacgtccgtggcaggggcttgatgttgggcgtggtgctggagcgcgacgtcgcaaagcaagctgttcttgatggttttaagcacggcgttattttgaatgcaccggcggacaacattatccgtttgaccccgccgctggtgatcaccgacgaagaaatcgcagacgcagtcaaggctattgccgagacaatcgcataaaggactcaaacttatgactt

SEQ ID NO: 60 - protein, 391 aa, Corynebacterium glutamicum
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVARKGELFKELLAKVDGVVDVRGRGLMLGVVLERDVAKQAVLDGFKHGVILNAPADNIIRLTPPLVITDEEIADAVKAIAETIA

SEQ ID NO: 61 - DNA, 1008 bp, Corynebacterium glutamicum
  CDS (101)..(985): RXC00733
acggcgaggttgtcggtattggaacgcacacgaatttgctgaacacgtgcggtacctaccgtgaaattgttgaatcccaagagactgcgcaggcgcaatcatgagtaatactgcaggcccccgcgggcgttcccatcaggcagacgccgcgccgaatcaaaaggcacagaatttcggaccatctgccaaaaggcttttcggaattctaggccatgaccgtaacaccttaatttttgttatcttcctagccgtcctgagcgttggacttaccgtcttgggcccatggttgctgggtaaagccaccaacgtggtgtttgaaggattcctatctaagcgcatgccggctggtgcgtcaaaggaagatatcatcgcgcagttgcaggctgcaggtaaacataatcaggcttccatgatggaagacatgaaccttgttccaggctcaggcattgattttgaaaaattagccatgatcctcggactggtgatcggtgcttatctcatcggtagcctgttgtcgttgttccaggcgcggatgctcaaccgcatcgtgcaaagtgccatgcaccggctgcgcatggaggtggaggaaaaaatccaccgcctaccgctgagctatttcgattccatcaaacgtggtgatctgcttagccgtgtgaccaacgatgtggataatatcggtcaatccctgcaacaaaccttgtcacaggcgatcacttccctactgaccgtcatcggtgtgttggtgatgatgtttatcatctccccactgctcgcactcgtggcgctggtatccattccggtcaccatcgtggtcactgtggtggttgcgagccgttcccagaaactctttgcggaacagtggaagcagaccggtattttgaatgcgcgcctggaggaaacctactctggccacgccgtggttaaggttttcggacaccaaaaggatgttcaagaagcattcgaggaagaaaatcaagcttgtgtataaggccagctttggtgcccagt

SEQ ID NO: 62 - protein, 295 aa, Corynebacterium glutamicum
MSNTAGPRGRSHQADAAPNQKAQNFGPSAKRLFGILGHDRNTLIFVIFLAVLSVGLTVLGPWLLGKATNVVFEGFLSKRMPAGASKEDIIAQLQAAGKHNQASMMEDMNLVPGSGIDFEKLAMILGLVIGAYLIGSLLSLFQARMLNRIVQSAMHRLRMEVEEKIHRLPLSYFDSIKRGDLLSRVTNDVDNIGQSLQQTLSQAITSLLTVIGVLVMMFIISPLLALVALVSIPVTIVVTVVVASRSQKLFAEQWKQTGILNARLEETYSGHAVVKVFGHQKDVQEAFEEENQACV

SEQ ID NO: 63 - DNA, 426 bp, Corynebacterium glutamicum
  CDS (1)..(426): RXC00861
atggctcctcacaaggtcatgctgattaccactggtactcagggtgagcctatggctgcgctgtctcgcatggcgcgtcgtgagcaccgacagatcactgtccgtgatggagacttgattatcctttcttcctccctggttccaggtaacgaagaagcagtgttcggtgtcatcaacatgctggctcagatcggtgcaactgttgttaccggtcgcgacgccaaggtgcacacctcgggccacggctactccggagagctgttgttcttgtacaacgccgctcgtccgaagaacgctatgcctgtccacggcgagtggcgccacctgcgcgccaacaaggaactggctatctccactggtgttaaccgcgacaacgttgtgcttgcacaaaacggtgttgtggttgatatggtcaacggtcgcgca

SEQ ID NO: 64 - protein, 142 aa, Corynebacterium glutamicum
MAPHKVMLITTGTQGEPMAALSRMARREHRQITVRDGDLIILSSSLVPGNEEAVFGVINMLAQIGATVVTGRDAKVHTSGHGYSGELLFLYNAARPKNAMPVHGEWRHLRANKELAISTGVNRDNVVLAQNGVVVDMVNGRA

SEQ ID NO: 65 - DNA, 1066 bp, Corynebacterium glutamicum
  CDS (101)..(1066): RXC00866
gcatcaacgtaggagatcctcgacttccaattatggctccaaatgagcaggaacttgaggctctccgagaagacatgaaaaaagctggagttctataaatatgaatgattcccgaaatcgcggccggaaggttacccgcaaggcgggcccaccagaagctggtcaggaaaaccatctggatacccctgtctttcaggcaccagatgcttcctctaaccagagcgctgtaaaagctgagaccgccggaaacgacaatcgggatgctgcgcaaggtgctcaaggatcccaagattctcagggttcccagaacgctcaaggttcccagaaccgcgagtccggaaacaacaaccgcaaccgttccaacaacaaccgtcgcggtggtcgtggacgtcgtggatccggaaacgccaatgagggcgcgaacaacaacagcggtaaccagaaccgtcagggcggaaaccgtggcaaccgcggtggcggacgccgaaacgttgttaagtcgatgcagggtgcggatctgacccagcgcctgccagagccaccaaaggcaccggcaaacggtctgcgtatttacgcacttggtggcatttccgaaatcggtcgcaacatgaccgtgtttgagtacaacaaccgtctgctcatcgtggactgtggtgtgctcttcccatcttcaggtgagccaggcgttgacctgattcttcctgacttcggcccaattgaggatcacctgcaccgcgtcgatgcattggtggttactcacggacacgaagaccacattggtgctattccctggctgctgaagctgcgcaacgatatcccaatcttggcatcccgtttcaccttggctctgattgcagctaagtgtaaggaacaccgtcagcgtccgaagctgatcgaggtcaacgagcagtccaatgaggaccgcggaccgttcaacattcgcttctgggctgttaaccactccatcccagactgccttggtcttgctatcaagactcctgctggtttggtcatccacaccggtgacatcaagctggatcagactcctcctgatggacgcccaact

SEQ ID NO: 66 - protein, 322 aa, Corynebacterium glutamicum
MNDSRNRGRKVTRKAGPPEAGQENHLDTPVFQAPDASSNQSAVKAETAGNDNRDAAQGAQGSQDSQGSQNAQGSQNRESGNNNRNRSNNNRRGGRGRRGSGNANEGANNNSGNQNRQGGNRGNRGGGRRNVVKSMQGADLTQRLPEPPKAPANGLRIYALGGISEIGRNMTVFEYNNRLLIVDCGVLFPSSGEPGVDLILPDFGPIEDHLHRVDALVVTHGHEDHIGAIPWLLKLRNDIPILASRFTLALIAAKCKEHRQRPKLIEVNEQSNEDRGPFNIRFWAVNHSIPDCLGLAIKTPAGLVIHTGDIKLDQTPPDGRPT

SEQ ID NO: 67 - DNA, 1527 bp, Corynebacterium glutamicum
  CDS (101)..(1504): RXC02095
ctctcttggtcctctccccacccatttttaagtactcaagacccttccaacagaaaggattactcccccaacaggctcaaaaatactgaaaggctcacgcatgaaaactgagcaatcccaaaaagcacaattagcccctaagaaagcacctgaaaagccacaacgcatccgccaacttatttccgtggcgtggcagcgaccttggctcacctcattcaccgtaatcagcgctttagctgcaacgttgtttgaacttacacttcctcttttgaccggtggcgccatcgatatcgcgctcggaaataccggagatactttaaccactgacctgctggaccggttcactccgagtggattaagcgtgttgaccagcgtcattgcccttatcgtgcttctcgcgttgcttcgctatgccagtcaatttggacggcgatacaccgcaggcaagctcagcatgggggtacagcatgatgtccggcttaaaacgatgcgctcattgcagaacctcgatgggccaggtcaggactctattcgcacaggccaagtagtcagtcggtccatttcggatatcaacatggtgcaaagccttgtggcgatgttgccgatgttgatcggaaatgtggtcaagcttgtgctcactttggtgatcatgctggctatttccccgccgctgaccatcatcgctgcagtgttggtgcctttgctgttgtgggccgtggcctattcgcgaaaagcgctttttgcgtccacgtggtcggcccagcaaaaggctgcggatctgaccactcatgtggaagaaactgtcacgggtatccgcgtggtcaaggcatttgcgcaggaagaccgcgagaccgacaaattggatctcaccgcacgtgagttatttgcccagcgcatgcgcactgcacgtctgacggcaaagttcatccccatggttgagcagcttccgcagcttgctttggtggtcaacattgttggcggtggctatttggccatgactggtcacatcacggtgggcacgtttgtggcgttttcttcctatctcactagcttgtcggcggtggctaggtccctgtcgggcatgctcatgcgcgtgcagttggcgctgtcttctgtggagcgcatctttgaagtcattgatcttcagcctgaacgcaccgatcctgcacaccccctgtcacttcccgacactcccctgggtctgtcgttcaacaacgtagatttccgtgggattctcaacggttttgagctgggtgttcaggccggtgaaaccgttgtgttggtgggccctccaggttcaggcaagaccatggctgtgcagcttgctggaaacttttatcaaccagacagcggccacatcgcctttgatagcaacggccatcgcactcgcttcgacgacctcacccacagcgatatccgcaggaatctcatcgcggtttttgatgagccgttcttgtactcctcctccataccgcgagaacatctcgatgggtttggatgtcagtgatgagcagatcgaacacgcag

SEQ ID NO: 68 - protein, 468 aa, Corynebacterium glutamicum
MKTEQSQKAQLAPKKAPEKPQRIRQLISVAWQRPWLTSFTVISALAATLFELTLPLLTGGAIDIALGNTGDTLTTDLLDRFTPSGLSVLTSVIALIVLLALLRYASQFGRRYTAGKLSMGVQHDVRLKTMRSLQNLDGPGQDSIRTGQVVSRSISDINMVQSLVAMLPMLIGNVVKLVLTLVIMLAISPPLTIIAAVLVPLLLWAVAYSRKALFASTWSAQQKAADLTTHVEETVTGIRVVKAFAQEDRETDKLDLTARELFAQRMRTARLTAKFIPMVEQLPQLALVVNIVGGGYLAMTGHITVGTFVAFSSYLTSLSAVARSLSGMLMRVQLALSSVERIFEVIDLQPERTDPAHPLSLPDTPLGLSFNNVDFRGILNGFELGVQAGETVVLVGPPGSGKTMAVQLAGNFYQPDSGHIAFDSNGHRTRFDDLTHSDIRRNLIAVFDEPFLYSSSIPREHLDGFGCQ

SEQ ID NO: 69 - DNA, 295 bp, Corynebacterium glutamicum
  CDS (84)..(272): RXC03185
  misc_feature 57: n = a, g, c, or t
agcgcccaaccgttcagaccagcggtttctctgaggatgcaaagtccatgatgggtnaggtcactgagctgtccgaaaccaccatgaatgatcttgcagctgaaggtgaaaacgatccttaccgcatggttcagcagctgcgccgcaagctctctcgcttcgtcgagcagaagtggaagcgccagccggtcatcatgccaaccgtcattccgatgactgcggaaaccacgcacatcggtgacgatgaggttcgcgcttcacgcgagtccctgtaaaagcatttcgcttttcgacg

SEQ ID NO: 70 - protein, 63 aa, Corynebacterium glutamicum
MNDLAAEGENDPYRMVQQLRRKLSRFVEQKWKRQPVIMPTVIPMTAETTHIGDDEVRASRESL

SEQ ID NO: 71 - DNA, 4653 bp, Corynebacterium glutamicum
  CDS (101)..(4630): RXN00367
atcgaaagtaacccttttgttacttgcgttgcaggtagtgtccctgattttcttattatcgaacgattgatagaaacaggattaaagtgaggtatcccgcatgaaaccacaaggactctacaaccctgcgcatgaacatgacgcctgcggtgtggcgtttattgcggatatccacggtcgacccagccgcagcattgttgatcgtgcacttgaggcgcttcgcaacattgaccaccgaggtgccgccggtgcagagaagaacactggcgatggtgcgggcatcctcatgcagattccggacggcttttatcgtgaagtatctggcattgagcttcctgaggcaggggagtatgccactggtattgcgttcttgcctcgcggtcgcatggcgatgatggatgctcagaaggaaattgagcgcatcgcaaagcaagaaggtgccgatgtgcttggttggcgcatggttccttttgattctcgtgatttgggttccatggctgaggaggcgatgcctagtttcgcgcagattttccttactgtgcctggaaaatctggtgaagatcttgaccgtgtgatgttctttatccgtaagcgttgtgagcgtgagctgggcaccaccaatggtcgcgatacggtgtatttcccgtcgctatcttcacgcaccatcatttacaaaggcatgttgaccactctgcagcttgagggcttctttgaggatctgggtgatgctcgcctggagtcggccattgctattgtgcactcgcgtttctccacgaacactttcccaagctggccgctggcgcacccgtaccgtttcgttgcccacaacggtgagatcaacactgtgcgtggcaatgaaaactggatgcgcgcccgcgaggcgcttatcaaaaacgacaagctgggcaatttgagcagcgtgctgcctatctgcaccccggagggctcggataccgcgcgtttcgacgaggctttggagcttttgcacctgggcggatactcacttccgcatgctgttgcgatgatgatccctcaggcgtgggaacacaacaagacgctgagccctgagctgcgtgatttctacgaataccactcttgtctgatggagccatgggatggtcctgcagcgctggcatttactgacggtcgttttgtgggtgccgtgctggaccgtaatggcctgcgacctgggcgaatcaccattactgattcgggtttggttgtgatggcttctgaatcgggagtgttggacttgagggaggagagcgtcgtaaagcgtactcgcgtacagcctggacgcatgttccttgttgacactgccgagggccgcatcgttgaagacgaggaaatcaagcagaaattaagcgaagcgcagccatatggtgagtggattcgcgataattttgtgcatctggatcgtctgcctcagacacgctacaactacatggcgcactctcgtgctgtgttgcgtcagcgtgttttcggaatcactgaagaagatgtggatttgttgctgctgccgatggcccgccagggtgctgaggcgattggttccatgggttcggatacgccaattgcggcgctatcccagcgaccacgcatgctttatgatttcttcgcgcagcgctttgctcaggtgacaaacccaccgttggactctatccgcgaaaagcctgtgaccagcatgttcactttgttgggtgcgcagtctgacgtgctcaatccgggtcctgatgcggcgcgacgtatccgtttggaatcgccgatcattgataaccatgagctggccaccttgatcaatgccaacgcgcatggtgagtgggattcctttggtgctgctgtaatttctggtttgtacccagtggctcaccatggtgccggcatgaaggctgcgattgctcgtgtgcgccgcgaggtttctgaagcaatccgcaatggcaagacgttgatcgtgctgtcggatcgtgaatctgatgagcgcatggcacctatccctgcgctgctgctgacttccgctgtgcatcagtacttggtgcagcaacgtacccgtacccagtgctccctggtggtggaatccggcgatgcccgcgaggttcatcacctggcgatgctcattggttttggtgccgatgcgatcaacccgtacatggcatttgaaaccatcgatgagctgcgcatgaagggtcagttgggtgatctttctttggatgaggcatcccgaaactacatcaaggcagccaccactggtgtgctgaaggtgatgtccaagatgggcattgcaacggtgtcttcgtaccgtggcgcgcagcttgccgatgtcactggtctgcaccaggatctcctggacaactacttcggtggtattgcttcaccaatttctggcatcggtctggatgaagttgcagctgacgtagaagctcgtcaccgcagcgcatttttgccacgccctgaagagcacgctcaccgtgaattggatttgggtggtgaatacaagtggcgccgcgaaggtgaataccacctgttcaacccagaaaccatcttcaagctgcagcatgcaacgcgttctggcagctacgagattttcaaggattacacccgcaaggttgatgatcaatccactcgcttgggtactattcgtggactgtttgagttcagcacggaccgcaagccaatttcggtgtctgaggtggagccggtcagtgagatcgtgaagcgtttctccactggtgcgatgtcttatggctcgatttctgctgaagcccatgaggtcttggccatcgccatgaaccgactgggcggtatgtccaactccggcgaaggtggcgaggacgcccgccgatttgatgtggaacccaacggtgactggaagcgctctgccattaagcaggtggcctcgggacgtttcggcgtgaccagccactacttgaacaactgcaccgatattcagatcaagatggcacagggcgcaaagcccggtgaaggtggccagctgccaccaaacaaggtgtacccatgggttgcagaagtccgcatcaccaccccaggcgttggtctgatttcccctccaccacaccacgatatttactccattgaggatctggctcagctgatccacgacctgaagaacgctaacccacgcgcacgaatccacgtgaagctagtggcagaacaaggcgtgggcaccgttgccgcaggtgtgtccaaagcacacgctgatgtggtgcttatttccggccacgatggcggaactggcgcatctcctttgacctccctgaagcatgccggtggtccatgggagttgggcttggctgaaacccagcaaacgttgctgctcaacggcctgcgcgatcgtattcgcgtgcagtgcgatggtcagctgaaaactggccgagacgtggttatcgcagctcttctcggtgccgaagaattcggttttgccaccgcaccgctggtggttgaaggctgcatcatgatgcgcgtctgccacctggacacctgcccggtgggtatcgctacccagaacccggatttgcgttccaagttcaccggcaaggctgaacacgtggtcaacttcttcaccttcatcgcccaggaagtccgtgagtacttggcacagcttggtttccgctctattgatgaagccgtcggacaagcccaggtgctgcgcaagcgttccggaatcccagctgattcccgcgcagcacacctggatttgagcccaattttccatcgcccagaaactccacacttcccaactcaggatgtgcgttgcaccaagacccaggaacacagcctagaaaaagccctggacaacgcatttattgataaggcttcggacacgatcacccgtgccgcagcgggtgtggaaaccagcattgttattgatagctccatcagcaacgtcaaccgttcagttggcacgatgctgggttctgcagtcagccgcgtggctggtgcccaaggtttgccagacggcaccatcaccttgaatcttcaaggctgcgccggtaactcctttggcgcgttcatcccacgaggcatcaccatcaacctcaccggcgatgccaatgactttgtgggcaagggattatctggcggaaagattgtgatcaagccttccgctcaggctccgaagcagctgaagaacaatccaaatatcattgccggaaacgtgcttggatacggcgcaaccagtggtgaattgttcattcgtggccaggtcggcgaacgtttctgcgtccgtaactctggcgccaccgcagtggttgaaggtatcggaaaccacggttgtgagtacatgactggcggccgagtcctggttttgggcccggttggtgagaactttggtgccggcatgtctggtggcattgcatacctggctaattccccggacctaaaccagaagatcaatggcgaattggtggatgttgttccactgagcgctgacgatctgacgtgggctgatgagctcattgctcgccaccgcgaactcaccggatccgagaccaagctgcgtgcacaagatttggtgaaaatcatgccgcgcgatttccaaaaagtactcaacatcatcgaaacggcccacgctgagggccaagacccagcaatcaagatcatggaggcagtgagctaatggccgacccacaaggattc

SEQ ID NO: 72 - protein, 1510 aa, Corynebacterium glutamicum
MKPQGLYNPAHEHDACGVAFIADIHGRPSRSIVDRALEALRNIDHRGAAGAEKNTGDGAGILMQIPDGFYREVSGIELPEAGEYATGIAFLPRGRMAMMDAQKEIERIAKQEGADVLGWRMVPFDSRDLGSMAEEAMPSFAQIFLTVPGKSGEDLDRVMFFIRKRCERELGTTNGRDTVYFPSLSSRTIIYKGMLTTLQLEGFFEDLGDARLESAIAIVHSRFSTNTFPSWPLAHPYRFVAHNGEINTVRGNENWMRAREALIKNDKLGNLSSVLPICTPEGSDTARFDEALELLHLGGYSLPHAVAMMIPQAWEHNKTLSPELRDFYEYHSCLMEPWDGPAALAFTDGRFVGAVLDRNGLRPGRITITDSGLVVMASESGVLDLREESVVKRTRVQPGRMFLVDTAEGRIVEDEEIKQKLSEAQPYGEWIRDNFVHLDRLPQTRYNYMAHSRAVLRQRVFGITEEDVDLLLLPMARQGAEAIGSMGSDTPIAALSQRPRMLYDFFAQRFAQVTNPPLDSIREKPVTSMFTLLGAQSDVLNPGPDAARRIRLESPIIDNHELATLINANAHGEWDSFGAAVISGLYPVAHHGAGMKAAIARVRREVSEAIRNGKTLIVLSDRESDERMAPIPALLLTSAVHQYLVQQRTRTQCSLVVESGDAREVHHLAMLIGFGADAINPYMAFETIDELRMKGQLGDLSLDEASRNYIKAATTGVLKVMSKMGIATVSSYRGAQLADVTGLHQDLLDNYFGGIASPISGIGLDEVAADVEARHRSAFLPRPEEHAHRELDLGGEYKWRREGEYHLFNPETIFKLQHATRSGSYEIFKDYTRKVDDQSTRLGTIRGLFEFSTDRKPISVSEVEPVSEIVKRFSTGAMSYGSISAEAHEVLAIAMNRLGGMSNSGEGGEDARRFDVEPNGDWKRSAIKQVASGRFGVTSHYLNNCTDIQIKMAQGAKPGEGGQLPPNKVYPWVAEVRITTPGVGLISPPPHHDIYSIEDLAQLIHDLKNANPRARIHVKLVAEQGVGTVAAGVSKAHADVVLISGHDGGTGASPLTSLKHAGGPWELGLAETQQTLLLNGLRDRIRVQCDGQLKTGRDVVIAALLGAEEFGFATAPLVVEGCIMMRVCHLDTCPVGIATQNPDLRSKFTGKAEHVVNFFTFIAQEVREYLAQLGFRSIDEAVGQAQVLRKRSGIPADSRAAHLDLSPIFHRPETPHFPTQDVRCTKTQEHSLEKALDNAFIDKASDTITRAAAGVETSIVIDSSISNVNRSVGTMLGSAVSRVAGAQGLPDGTITLNLQGCAGNSFGAFIPRGITINLTGDANDFVGKGLSGGKIVIKPSAQAPKQLKNNPNIIAGNVLGYGATSGELFIRGQVGERFCVRNSGATAVVEGIGNHGCEYMTGGRVLVLGPVGENFGAGMSGGIAYLANSPDLNQKINGELVDVVPLSADDLTWADELIARHRELTGSETKLRAQDLVKIMPRDFQKVLNIIETAHAEGQDPAIKIMEAVS

SEQ ID NO: 73 - DNA, 1906 bp, Corynebacterium glutamicum
  CDS (101)..(1906): FRXA00007
atcgaaagtaacccttttgttacttgcgttgcaggtagtgtccctgattttcttattatcgaacgattgatagaaacaggattaaagtgaggtatcccgcatgaaaccacaaggactctacaaccctgcgcatgaacatgacgcctgcggtgtggcgtttattgcggatatccacggtcgacccagccgcagcattgttgatcgtgcacttgaggcgcttcgcaacattgaccaccgaggtgccgccggtgcagagaagaacactggcgatggtgcgggcatcctcatgcagattccggacggcttttatcgtgaagtatctggcattgagcttcctgaggcaggggagtatgccactggtattgcgttcttgcctcgcggtcgcatggcgatgatggatgctcagaaggaaattgagcgcatcgcaaagcaagaaggtgccgatgtgcttggttggcgcatggttccttttgattctcgtgatttgggttccatggctgaggaggcgatgcctagtttcgcgcagattttccttactgtgcctggaaaatctggtgaagatcttgaccgtgtgatgttctttatccgtaagcgttgtgagcgtgagctgggcaccaccaatggtcgcgatacggtgtatttcccgtcgctatcttcacgcaccatcatttacaaaggcatgttgaccactctgcagcttgagggcttctttgaggatctgggtgatgctcgcctggagtcggccattgctattgtgcactcgcgtttctccacgaacactttcccaagctggccgctggcgcacccgtaccgtttcgttgcccacaacggtgagatcaacactgtgcgtggcaatgaaaactggatgcgcgcccgcgaggcgcttatcaaaaacgacaagctgggcaatttgagcagcgtgctgcctatctgcaccccggagggctcggataccgcgcgtttcgacgaggctttggagcttttgcacctgggcggatactcacttccgcatgctgttgcgatgatgatccctcaggcgtgggaacacaacaagacgctgagccctgagctgcgtgatttctacgaataccactcttgtctgatggagccatgggatggtcctgcagcgctggcatttactgacggtcgttttgtgggtgccgtgctggaccgtaatggcctgcgacctgggcgaatcaccattactgattcgggtttggttgtgatggcttctgaatcgggagtgttggacttgagggaggagagcgtcgtaaagcgtactcgcgtacagcctggacgcatgttccttgttgacactgccgagggccgcatcgttgaagacgaggaaatcaagcagaaattaagcgaagcgcagccatatggtgagtggattcgcgataattttgtgcatctggatcgtctgcctcagacacgctacaactacatggcgcactctcgtgctgtgttgcgtcagcgtgttttcggaatcactgaagaagatgtggatttgttgctgctgccgatggcccgccagggtgctgaggcgattggttccatgggttcggatacgccaattgcggcgctatcccagcgaccacgcatgctttatgatttcttcgcgcagcgctttgctcaggtgacaaacccaccgttggactctatccgcgaaaagcctgtgaccagcatgttcactttgttgggtgcgcagtctgacgtgctcaatccgggtcctgatgcggcgcgacgtattcgtttggaatcgccgatcattgataaccatgagctggccaccttgatcaatgccaacgcgcatggtgagtgggattcctttggtgctgctgtaatttctggtttgtacccagtggctcaccatggtgccggcatgaaggctgcgattgctcgtgtg

SEQ ID NO: 74 - protein, 602 aa, Corynebacterium glutamicum
MKPQGLYNPAHEHDACGVAFIADIHGRPSRSIVDRALEALRNIDHRGAAGAEKNTGDGAGILMQIPDGFYREVSGIELPEAGEYATGIAFLPRGRMAMMDAQKEIERIAKQEGADVLGWRMVPFDSRDLGSMAEEAMPSFAQIFLTVPGKSGEDLDRVMFFIRKRCERELGTTNGRDTVYFPSLSSRTIIYKGMLTTLQLEGFFEDLGDARLESAIAIVHSRFSTNTFPSWPLAHPYRFVAHNGEINTVRGNENWMRAREALIKNDKLGNLSSVLPICTPEGSDTARFDEALELLHLGGYSLPHAVAMMIPQAWEHNKTLSPELRDFYEYHSCLMEPWDGPAALAFTDGRFVGAVLDRNGLRPGRITITDSGLVVMASESGVLDLREESVVKRTRVQPGRMFLVDTAEGRIVEDEEIKQKLSEAQPYGEWIRDNFVHLDRLPQTRYNYMAHSRAVLRQRVFGITEEDVDLLLLPMARQGAEAIGSMGSDTPIAALSQRPRMLYDFFAQRFAQVTNPPLDSIREKPVTSMFTLLGAQSDVLNPGPDAARRIRLESPIIDNHELATLINANAHGEWDSFGAAVISGLYPVAHHGAGMKAAIARV

SEQ ID NO: 75 - DNA, 1362 bp, Corynebacterium glutamicum
  CDS (70)..(1362): FRXA00364
accaatttctggcatcggtctggatgaagttgcagctgacgtagaaagctcgtcaccgcagcgcattttttgccacgccctgaagagcacgctcaccgtgaattggatttgggtggtgaatacaagtggcgccgcgaaggtgaataccacctgttcaacccagaaaccatcttcaagctgcagcatgcaacgcgttctggcagctacgagattttcaaggattacacccgcaaggttgatgatcaatccactcgcttgggtactattcgtggactgtttgagttcagcacggaccgcaagccaatttcggtgtctgaggtggagccggtcagtgagatcgtgaagcgtttctccactggtgcgatgtcttatggctcgatttctgctgaagcccatgaggtcttggccatcgccatgaaccgactgggcggtatgtccaactccggcgaaggtggcgaggacgcccgccgatttgatgtggaacccaacggtgactggaagcgctctgccattaagcaggtggcctcgggacgtttcggcgtgaccagccactacttgaacaactgcaccgatattcagatcaagatggcacagggcgcaaagcccggtgaaggtggccagctgccaccaaacaaggtgtacccatgggttgcagaagtccgcatcaccaccccaggcgttggtctgatttcccctccaccacaccacgatatttactccattgaggatctggctcagctgatccacgacctgaagaacgctaacccacgcgcacgaatccacgtgaagctagtggcagaacaaggcgtgggcaccgttgccgcaggtgtgtccaaagcacacgctgatgtggtgcttatttccggccacgatggcggaactggcgcatctcctttgacctccctgaagcatgccggtggtccatgggagttgggcttggctgaaacccagcaaacgttgctgctcaacggcctgcgcgatcgtattcgcgtgcagtgcgatggtcagctgaaaactggccgagacgtggttatcgcagctcttctcggtgccgaagaattcggttttgccaccgcaccgctggtggttgaaggctgcatcatgatgcgcgtctgccacctggacacctgcccggtgggtatcgctacccagaacccggatttgcgttccaagttcaccggcaaggctgaacacgtggtcaacttcttcaccttcatcgcccaggaagtccgtgagtacttggcacagcttggtttccgctctattgatgaagccgtcggacaagcccaggtgctgcgcaagcgttccggaatcccagctgattcccgcgcagcacacctggatttgagcccaattttcatc

SEQ ID NO: 76 - protein, 431 aa, Corynebacterium glutamicum
LPRPEEHAHRELDLGGEYKWRREGEYHLFNPETIFKLQHATRSGSYEIFKDYTRKVDDQSTRLGTIRGLFEFSTDRKPISVSEVEPVSEIVKRFSTGAMSYGSISAEAHEVLAIAMNRLGGMSNSGEGGEDARRFDVEPNGDWKRSAIKQVASGRFGVTSHYLNNCTDIQIKMAQGAKPGEGGQLPPNKVYPWVAEVRITTPGVGLISPPPHHDIYSIEDLAQLIHDLKNANPRARIHVKLVAEQGVGTVAAGVSKAHADVVLISGHDGGTGASPLTSLKHAGGPWELGLAETQQTLLLNGLRDRIRVQCDGQLKTGRDVVIAALLGAEEFGFATAPLVVEGCIMMRVCHLDTCPVGIATQNPDLRSKFTGKAEHVVNFFTFIAQEVREYLAQLGFRSIDEAVGQAQVLRKRSGIPADSRAAHLDLSPIFI

SEQ ID NO: 77 - DNA, 866 bp, Corynebacterium glutamicum
  CDS (1)..(843): FRXA00367
cacagcctagaaaaagccctggacaacgcatttattgataaggcttcggacacgatcacccgtgccgcagcgggtgtggaaaccagcattgttattgatagctccatcagcaacgtcaaccgttcagttggcacgatgctgggttctgcagtcagccgcgtggctggtgcccaaggtttgccagacggcaccatcaccttgaatcttcaaggctgcgccggtaactcctttggcgcgttcatcccacgaggcatcaccatcaacctcaccggcgatgccaatgactttgtgggcaagggattatctggcggaaagattgtgatcaagccttccgctcaggctccgaagcagctgaagaacaatccaaatatcattgccggaaacgtgcttggatacggcgcaaccagtggtgaattgttcattcgtggccaggtcggcgaacgtttctgcgtccgtaactctggcgccaccgcagtggttgaaggtatcggaaaccacggttgtgagtacatgactggcggccgagtcctggttttgggcccggttggtgagaactttggtgccggcatgtctggtggcattgcatacctggctaattccccggacctaaaccagaagatcaatggcgaattggtggatgttgttccactgagcgctgacgatctgacgtgggctgatgagctcattgctcgccaccgcgaactcaccggatccgagaccaagctgcgtgcacaagatttggtgaaaatcatgccgcgcgatttccaaaaagtactcaacatcatcgaaacggcccacgctgagggccaagacccagcaatcaagatcatggaggcagtgagctaatggccgacccacaaggattc

SEQ ID NO: 78 - protein, 281 aa, Corynebacterium glutamicum
HSLEKALDNAFIDKASDTITRAAAGVETSIVIDSSISNVNRSVGTMLGSAVSRVAGAQGLPDGTITLNLQGCAGNSFGAFIPRGITINLTGDANDFVGKGLSGGKIVIKPSAQAPKQLKNNPNIIAGNVLGYGATSGELFIRGQVGERFCVRNSGATAVVEGIGNHGCEYMTGGRVLVLGPVGENFGAGMSGGIAYLANSPDLNQKINGELVDVVPLSADDLTWADELIARHRELTGSETKLRAQDLVKIMPRDFQKVLNIIETAHAEGQDPAIKIMEAVS

SEQ ID NO: 79 - DNA, 1494 bp, Corynebacterium glutamicum
  CDS (101)..(1471): RXN00076
tctaggagtgttaaacagcctggacttgaaacacctttaactacttgattttcacacccttgtttccataaaagggctcacgaaaggcaacttcaaacacatgacaactcccctgcgcgtagccgtcatcggagctggccctgctggcatttacgcatccgacctcctcatccgcaatgaagagcgcgaagtgttcgttgaccttttcgagcaaatgcctgcaccgttcggactcatccgttacggcgttgctccagaccacccacgcatcaagggcatcgttaagtccctgcacaacgtgttggacaagccacgcctgcgcctgctcggtaacattgaaatcggcaaagacatcaccgtcgaagaactccgcgactactacgatgcagtcgtgttctccaccggcgcagttgcagaccgcgacctcaacatccccggaattgaagcagaaggctccttcggtgccggcgagttcgttggcttctacgacggcaacccacgcttcgagcgctcctgggatctgtctgcacagtccgtcgctgttatcggcgttggtaacgtcggcctcgacgtagcccgcatcctggctaagacaggcgacgagctcaaagtcaccgaaatttccgacaacgtctacgactccctcaaagaaaacaaggccactgaagtgcacgttttcggacgtcgtggcccagcacaggtcaagttcaccccacaggaactcaaagaactcgaccactcccccaccatcaacgtggttgttgatccagaagacatcgactacgacggcgcctctgaagaagcccgccgcgcatccaagtcccaggacctggtctgccagatcctggaacagtacgcaatccgcgagccaaaggacgctccgcacaccctgcagatccacctctttgaaaacccagttgaggttcttcaaaaggacggcaaggttgttggcctgcgcaccgaacgcacctcacttgatggcaacggcggcgtaaacggaaccggcgaattcaaggactggccagtccaggctgtctaccgcgcagtcggctacaagtccgaccccatcgacggcgtcccattcgatgagaacaagcacgtcatccctaatgacggcggacatgtcctcaccgctccaggcgcagaaccagtaccaggcctctatgcaaccggctggatcaagcgtggaccaatcggtctaatcggcaacaccaagtccgacgccaaggaaaccaccgacatcctcatcaaggatgccgtcgccggtgtacttgaagctccaaagcaccagggcgaagaagccatcatcgagcttctcgattcccgcaacatcccattcaccacctgggaaggctggtacaaactcgacgcagcagagcgcgcactcggtgaagccgaaggccgcgagcgcaagaagattgttgattgggaagaaatggtccgccaggcccgcgaagctccagcaattgtctaaattgttttaacgcgtgaagc

SEQ ID NO: 80 - protein, 457 aa, Corynebacterium glutamicum
MTTPLRVAVIGAGPAGIYASDLLIRNEEREVFVDLFEQMPAPFGLIRYGVAPDHPRIKGIVKSLHNVLDKPRLRLLGNIEIGKDITVEELRDYYDAVVFSTGAVADRDLNIPGIEAEGSFGAGEFVGFYDGNPRFERSWDLSAQSVAVIGVGNVGLDVARILAKTGDELKVTEISDNVYDSLKENKATEVHVFGRRGPAQVKFTPQELKELDHSPTINVVVDPEDIDYDGASEEARRASKSQDLVCQILEQYAIREPKDAPHTLQIHLFENPVEVLQKDGKVVGLRTERTSLDGNGGVNGTGEFKDWPVQAVYRAVGYKSDPIDGVPFDENKHVIPNDGGHVLTAPGAEPVPGLYATGWIKRGPIGLIGNTKSDAKETTDILIKDAVAGVLEAPKHQGEEAIIELLDSRNIPFTTWEGWYKLDAAERALGEAEGRERKKIVDWEEMVRQAREAPAIV

SEQ ID NO: 81 - DNA, 786 bp, Corynebacterium glutamicum
  CDS (101)..(763): FRXA00075
  VARIANT 187: Xaa = Val or Ala
  VARIANT 188: Xaa = Thr or Ser
  VARIANT 209: Xaa = Lys or Gln
  VARIANT 212: Xaa = Arg
tctaggagtgttaaacagcctggacttgaaacacctttaactacttgattttcacacccttgtttccataaaagggctcacgaaaggcaacttcaaacacatgacaactcccctgcgcgtagccgtcatcggagctggccctgctggcatttacgcatccgacctcctcatccgcaatgaagagcgcgaagtgttcgttgaccttttcgagcaaatgcctgcaccgttcggactcatccgttacggcgttgctccagaccacccacgcatcaagggcatcgttaagtccctgcacaacgtgttggacaagccacgcctgcgcctgctcggtaacattgaaatcggcaaagacatcaccgtcgaagaactccgcgactactacgatgcagtcgtgttctccaccggcgcagttgcagaccgcgacctcaacatccccggaattgaagcagaaggctccttcggtgccggcgagttcgttggcttctacgacggcaacccacgcttcgagcgctcctgggatctgtctgcacagtccgtcgctgttatcggcgttggtaacgtcggcctcgacgtagcccgcatcctggctaagacaggcgacgagctcaaagtcaccgaaatttccgacaacgtctacgactccctcaaagaaaacaaggycwctgaagtgcacgttttcggacgtcggtggcccagcacaggtcaagttcaccccacaggaactmaaagaactcgrccactcccccaccatcaacgtggttgttgatccagaagacatcgactacg

SEQ ID NO: 82 - protein, 221 aa, Corynebacterium glutamicum
  VARIANT 187: Xaa = Val or Ala
  VARIANT 188: Xaa = Thr or Ser
  VARIANT 209: Xaa = Lys or Gln
  VARIANT 212: Xaa = Arg
MTTPLRVAVIGAGPAGIYASDLLIRNEEREVFVDLFEQMPAPFGLIRYGVAPDHPRIKGIVKSLHNVLDKPRLRLLGNIEIGKDITVEELRDYYDAVVFSTGAVADRDLNIPGIEAEGSFGAGEFVGFYDGNPRFERSWDLSAQSVAVIGVGNVGLDVARILAKTGDELKVTEISDNVYDSLKENKXXEVHVFGRRWPSTGQVHPTGTXRTXPLPHHQRGC

SEQ ID NO: 83 - DNA, 672 bp, Corynebacterium glutamicum
  CDS (101)..(649): RXN00198
atgcaggattagagcagcagcaacggagccagaatcagtctcccaatttgatatccagccccgcgctcctttccagcgcgccgattccactccatggccgatgtaccccaacctcttccgcaccgcaacggctcacgaagaaggcgaatacatcatcactggcgatgaatcagccgatgaaatcgcagccctgggcctcgccgaacgtgccgcaggctccacgcttggtgaacgtaaatttgctgtcaacaccgtggaattccacggcaacaacggccacgtcaccggactcaccggcaaccaaatccgagttgtcaacggcaaacgtgaaccaatcgaaggcaccgaattccccttcgaagcagacctcgttcttgttgcacttggcttcaccggcgcagaacaaggcggattggcacacgaactaggcgtaggtttcgacgaccggggccgcatcctccgcgattccgaataccgcagccccaccaactcccgcgtttacatcgcaggcgacaacggccgtggccagtccctgatcgtgtgggcaatcgccgaaggccgcgcatgcgccgcagctatcgacgccgatctcatgggtgaaactgcactccctgtagcagttgcaccacaggacgtgccgctggctgtctagcttgggtagaaaatgctaga

SEQ ID NO: 84 - protein, 183 aa, Corynebacterium glutamicum
MYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 85 - DNA, 305 bp, Corynebacterium glutamicum
  CDS (1)..(282): FRXA00198
ctcgttcttgttgcacttggcttcaccggcgcagaacaaggcggattggcacacgaactaggcgtaggtttcgacgaccggggccgcatcctccgcgattccgaataccgcagccccaccaactcccgcgtttacatcgcaggcgacaacggccgtggccagtccctgatcgtgtgggcaatcgccgaaggccgcgcatgcgccgcagctatcgacgccgatctcatgggtgaaactgcactccctgtagcagttgcaccacaggacgtgccgctggctgtctagcttgggtagaaaatgctaga

SEQ ID NO: 86 - protein, 94 aa, Corynebacterium glutamicum
LVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 87 - DNA, 727 bp, Corynebacterium glutamicum
  CDS (101)..(727): RXN00365
gaagcctacgatcgcttgcacgcgaccaacaatttccccgagttcaccggccgtttgtgccccgcaccctgcgaaggcgcctgcgtgctcggtatcaacgatgattctgtcaccatcaaaaacgtttgagctggaaatcgtcgaaaaagcattccgcgaaggctgggtgcaaccagtaatcccatccatgtctaccgggctgtcagtcgccgtcgtcggttccggccccgctggccttgccgccgcgcagcagctcacccgcgcaggccacagcgttaccgtctttgaacgcgacgaccgcctcggcggcctcatgcgctacggcgtgccagaatacaaaatggagaaccgctggatcgaccgccgcatcgagcaaatggaagcagagggcacaactttccaggtaggcacctcgccgcgcgccgctgaactagcgcttttcgacgcgatcctcctcgcaaccggcaccccagtggcccgcgaactctcagttccaggccacgatctcaacggcatccatgcggcaatggattacctcaccgcccaaaaccgcatcaacgaaggcgacggtgaagtctctccaatcaacgccaaaggcaagaaagttgtcatcatcggtggcggcgacaccggcaccgactgcttcggcaccgcactgcgccaaggagcagaatcagtcacccaatttgatatccgcccccgcgctcctttccagcgcgccgattcc

SEQ ID NO: 88 - protein, 209 aa, Corynebacterium glutamicum
MILSPSKTFELEIVEKAFREGWVQPVIPSMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADS

SEQ ID NO: 89 - DNA, 727 bp, Corynebacterium glutamicum; identical to SEQ ID NO: 87
  CDS (101)..(727): FRXA00365

SEQ ID NO: 90 - protein, 209 aa, Corynebacterium glutamicum; identical to SEQ ID NO: 88

SEQ ID NO: 91 - DNA, 480 bp, Corynebacterium glutamicum
  CDS (101)..(457): RXA00366
aaatcatgccgcgcgatttccaaaaagtactcaacatcatcgaaacggcccacgctgagggccaagacccagcaatcaagatcatggaggcagtgagctaatggccgacccacaaggattcatcaaatactcccgacgcgagcctgcacaccgcccggtcccgctgcgcctcatggaccactccgaggtctacgaaaaggcaccggcaggtcagatcgaggaacaggctgcccgctgcatggattgcggtgtcccgttctgccacgaaggctgcccactgggcaacatcatccctgagtggaatgatctggtacgccaaggtcggtggaaggaagcctacgatcgcttgcacgcgaccaacaatttccccgagttcaccggccgtttgtgccccgcaccctgcgaaggcgcctgcgtgctcggtatcaacgatgattctgtcaccatcaaaaacgtttgagctggaaatcgtcgaaaaag

SEQ ID NO: 92 - protein, 119 aa, Corynebacterium glutamicum
MADPQGFIKYSRREPAHRPVPLRLMDHSEVYEKAPAGQIEEQAARCMDCGVPFCHEGCPLGNIIPEWNDLVRQGRWKEAYDRLHATNNFPEFTGRLCPAPCEGACVLGINDDSVTIKNV

SEQ ID NO: 93 - DNA, 1464 bp, Corynebacterium glutamicum
  CDS (101)..(1441): RXA02072
tacatggtgccctcaatgggaaccaccaacatcactaaatggcccaggtacacactttaaaatcgtgcgcgcatgcagccgagatgggaacgaggaaatcatgacagttgatgagcaggtctctaactattacgacatgcttctgaagcgcaatgctggcgagcctgaatttcaccaggcagtggcagaggttttggaatctttgaagatcgtcctggaaaaggaccctcattacgctgattacggtctcatccagcgcctgtgcgagcctgagcgtcagctcatcttccgtgtgccttgggttgatgaccagggccaggtccacgtcaaccgtggtttccgcgtgcagttcaactctgcacttggaccatacaagggcggcctgcgcttccacccatctgtaaacctgggcattgtgaagttcctgggctttgagcagatctttaaaaactccctaaccggcctgccaatcggtggtggcaagggtggatccgacttcgaccctaagggcaagtccgatctggaaatcatgcgtttctgccagtccttcatgaccgagctgcaccgccacatcggtgagtaccgcgacgttcctgcaggtaacatcggagttggtggccacgagatcggttacctgtttggccactaccgtcgcatggctaaccagcacgagtccggcgttttgaccggtaagggcctgacctggggtggatccctggtccgcaccgaggcaactggctacggctgcgtttacttcgtgagtgaaatgatcaaggctaagggcgagagcatcagcggccagaagatcatcgtttccggttccggcaacgtagcaacctacgcgattgaaaaggctcaggaactcggcgcaaccgttattggtttctccgattccagcggttgggttcatacccctaacggcgttgacgtggctaagctccgcgaaatcaaggaagttcgtcgcgcacgcgtatccgtgtacgccgacgaagttgaaggcgcaacctaccacaccgacggttccatctgggatctcaagtgcgatatcgctcttccttgtgcaactcagaacgagctcaacggcgagaacgctaagactcttgcagacaacggctgccgtttcgttgctgaaggcgcgaacatgccttccacccctgaggctgttgaggtcttccgtgagcgcgacatccgcttcggaccaggcaaggcagctaacgctggtggcgttgcaacctccgctctggagatgcagcagaacgcttcgcgcgattcctggagcttcgagtacaccgacgagcgcctccaggtgatcatgaagaacatcttcaagacctgtgcagagaccgcagcagagtatggacacgagaacgattacgttgtcggcgctaacattgctggcttcaagaaggtagctgacgcgatgctggcacagggcgtcatctaagacccctgcgctttacttaa

SEQ ID NO: 94 - protein, 447 aa, Corynebacterium glutamicum
MTVDEQVSNYYDMLLKRNAGEPEFHQAVAEVLESLKIVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGNIGVGGHEIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKAANAGGVATSALEMQQNASRDSWSFEYTDERLQVIMKNIFKTCAETAAEYGHENDYVVGANIAGFKKVADAMLAQGVI

SEQ ID NO: 95 - DNA, 1461 bp, Corynebacterium glutamicum
  CDS (101)..(1438): RXA00323
cgcgacatccttgagtaactctgagaaaaactacccccgatgggagtataaaagtggcaaatgcgcagtcgatgtcccatcgctgcgtagattagttttcatgaacagcgaacaggaatttgtactcagcgccattgaagaacgcgacattaagtttgtgcgtctatggttcactgacattcttggccacttgaagtcagtggttgtggctcctgcagaactagagtctgcgttggaagaaggcatcggattcgatggctcagccattgagggctacgcgcgtatctcggaagcggacaccattgcccgcccagatccatcgacattccaggtcctcccactagaagcgggcatctcaaaactgcaggcagcacgcctgttttgcgatgtcacgatgccagacggacagccatctttttctgacccgcgccaagtgctgcgcaggcaggtccaactagctgcagatgaaggcttgacctgcatgatctcaccagagattgagttctatttggtgcaaagccttcgcaccaacggactgccacctgtgcccactgacaacggcggatatttcgaccaagccacattcaatgaggcgccgaatttccgtcgaaacgcgatggtagcgctggaggaactcggcatccctgtcgagttctcccaccatgaaactgcacctggccagcaagaaatcgatttacgccatgcggatgcgctcaccatggccgacaacatcatgaccttccgctacatcatgaaacaggtggcaagggaccaaggcgtcggggcatcatttatgcccaagccattccaagaacatgcaggctccgccatgcacacgcacatgtccttatttgagggcgataccaacgcgttccacgatccagacgattcttacatgctgtccaaaaccgcaaaacagttcatcgctggaatcttgcatcacgctccagaattcaccgctgtgaccaaccagtgggtcaattcctacaaacgcatcgtgtacggaaacgaagctccaactgcggcaacctggggtgtatctaatcgttctgcgctggttcgtgttcctacctaccgtttgaataaggaggagtcgcgccgggtggaggtgcgtcttcctgataccgcttgtaacccatatttggcgttttcagtgatgctcggcgctggtttgaaaggcattaaagaaggttatgagctcgacgagccagctgaggacgatatctccaacttgagcttccgggaacgtcgcgccatgggctacaacgatctgccaagcagccttgatcaggcactgcgccaaatggaaaagtcagagcttgttgctgacatcctcggtgagcacgtttttgagtttttcttgcgcaataagtggcgtgaatggcgtgactaccaagagcagatcactccgtgggagctccgaaacaatcttgattactagacttttgcactccaatggaa

SEQ ID NO: 96 - protein, 446 aa, Corynebacterium glutamicum
MNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 97 - DNA, 1554 bp, Corynebacterium glutamicum
  CDS (101)..(1531): RXA00335
actacatttgcagccaagtctactacttgatcttcaaaggtcagcaattgtgaacaaagctacaaataaaccgttccgcccatgtcaatgaggagtcaccgtggcgtttgaaaccccggaagaaattgtcaagttcatcaaggatgaaaacgtcgagttcgttgacgttcgattcaccgaccttcccggcaccgagcagcacttcagcatcccagctgccagcttcgatgcagatacaatcgaagaaggtctcgcattcgacggatcctcgatccgtggcttcaccacgatcgacgaatctgacatgaatctcctgccagacctcggaacggccacccttgatccattccgcaaggcaaagaccctgaacgttaagttcttcgttcacgatcctttcacccgcgaggcattctcccgcgacccacgcaacgtggcacgcaaggcagagcagtacctggcatccaccggcattgcagacacctgcaacttcggcgccgaggctgagttctacctcttcgactccgttcgctactccaccgagatgaactccggcttctacgaagtagataccgaagaaggctggtggaaccgtggcaaggaaaccaacctcgacggcaccccaaacctgggcgcaaagaaccgcgtcaagggtggctacttcccagtagcaccatacgaccaaaccgttgacgtgcgcgatgacatggttcgcaacctcgcagcttccggcttcgctcttgagcgtttccaccacgaagtcggtggcggacagcaggaaatcaactaccgcttcaacaccatgctccacgcggcagatgatatccagaccttcaagtacatcatcaagaacaccgctcgcctccacggcaaggctgcaaccttcatgcctaagccactggctggcgacaacggttccggcatgcacgctcaccagtccctctggaaggacggcaagccactcttccacgatgagtccggctacgcaggcctgtccgacatcgcccgctactacatcggcggcatcctgcaccacgcaggcgctgttctggcgttcaccaacgcaaccctgaactcctaccaccgtctggttccaggcttcgaggctccaatcaacctggtgtactcacagcgcaaccgttccgctgctgtccgtatcccaatcaccggatccaacccgaaggcaaagcgcatcgaattccgcgctccagacccatcaggcaacccatacctgggctttgcagcgatgatgatggccggcctcgacggcatcaagaaccgcatcgagccacacgctccagtggacaaggacctctacgaactaccaccagaggaagctgcatccattccacaggcaccaacctccctggaagcatccctgaaggcactgcaggaagacaccgacttcctcaccgagtctgacgtcttcaccgaggatctcatcgaggcgtacatccagtacaagtacgacaacgagatctccccagttcgcctgcgcccaaccccgcaggaattcgaattgtacttcgactgctaattcacttagctagccgatag

SEQ ID NO: 98 - protein, 477 aa, Corynebacterium glutamicum
VAFETPEEIVKFIKDENVEFVDVRFTDLPGTEQHFSIPAASFDADTIEEGLAFDGSSIRGFTTIDESDMNLLPDLGTATLDPFRKAKTLNVKFFVHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDFLTESDVFTEDLIEAYIQYKYDNEISPVRLRPTPQEFELYFDC

SEQ ID NO: 99 - DNA, 3258 bp, Corynebacterium glutamicum
  CDS (101)..(3235): RXA00324
tccgtgggagctccgaaacaatcttgattactagacttttgcactccaatggaaaccctacggcgacccaattgcgacccgatgaaggaggggagaagctatgtcaggaccgttaagaagtgaacgtaaagtcgttggctttgtcagagacccactgccaaaagttggttctttatcgctgaaatctgagcatgcccaagcagatctagagcatttgggttggcgcaatgttgagtctttggatttgttgtggggcttgtcaggtgcaggcgatcccgatgtcgcgctgaaccttcttattcggctgtatcaggcacttgaagcaatcggcgaggatgctcgaaacgagcttgatcaagagattcgccaggatgaaaaactacgagtccgcctttttgcattgttgggtggttcctcggctgtcggtgatcacttggtcgccaatcctttgcagtggaaactcttaaaacttgatgcgccatcgagggaagagatgtttcaggcgctgctggaatctgtgaaagctcagcctgctgtgcttgaggttgaggatttcagcgatgcacacaacattgcccgagacgatttgagcacgcctggtttttacacggctagtgttaccgggcctgaagcagagcgagtcttgaaatggacttatcgcacgttgctgacccggattgctgcgcatgatttagcgggtacctatcccaccgacatgcggagaaaaggtggcgatcctgttccgtttagcacagtgaccatgcagctcagcgacctagctgatgctgctttgactgctgctttagctgtggcaattgccaatgtttatggtgaaaagccggttgattcagctttatctgtcatcgcgatgggcaaatgtggcgcgcaggaattgaactacatttcagatgtggacgtggtgtttgttgcagagccggcaaactctaaatcaacacgcaccgcagcagagctcattcgcatcggtagcaactcgttctttgaggtggatgcagcacttcgcccagaaggtaaaagtggcgctcttgtgcgctctttggattcccatatggcgtattacaagcgctgggcggaaacctgggagtttcaggcactgctgaaagctcgtcccatgacgggtgatattaaccttgggcagtcctatgtggatgctctttcaccgttgatttggacggctagccagcgggaatcatttgtcacagatgtccaagctatgcgccgtcgagtgttggacaatgttccggaagacttgcgtgatcgtgagctgaagcttggtcgcggtggtttgagggatgtggagtttgctgtccagctccttcagatggtgcatggtcgcattgatgagacgttgcgggttcggtcaacggtaaatgctttgcatgtgttggttgatcagggatatgtgggtcgtgaagacgggcataatctcattgagtcgtatgagtttttgcgtctgttggagcatcgccttcaattggagcggatcaagcgcactcacttgttaccgaaacctgatgaccgaatgaatatgcgctggttggcgcgcgcttctgggtttactggttcgatggagcaaagttcggccaaagctatggaacggcatttgcgtaaggttcgtttgcagattcagtcgttgcatagtcagctgttttatcggccactgctgaactctgtggtcaacttgagcgcggatgccatcaggttgtctccggatgctgcaaagctacaattggcggcattgggatacctgcatccatcacgtgcttatgaacacctgactgctcttgcatcaggagctagccgtaaagccaagattcaggcgatgttgctgcccacgttgatggagtggctgtctcaaacagctgaaccagatgcgggattgctgaattaccgcaagctttctgatgcttcctatgatcgcagctggtttttgcgcatgctgcgtgatgagggcgtagtggggcagcggttgatgcgtattttgggaaattctccctatatttctgaactgattatctccactccggactttatgaaacagctgggtgatgcggcgtctggtcctaaattgcttgctactgcaccgactcaggttgtgaaagcaatcaaggcaacggtgtcgcgtcatgagtcacctgatcgggcgatccaggctgcacgatcgctgaggaggcaggagctggcacgcattgcctctgctgatttgctcaacatgctcactgttcaggaagtatgccaaagcttgtcactagtctgggatgcggtgttggatgctgccttggatgcggaaatccgtgctgcacttaacgatccacagaaaccagatcagcctctggccaatatttctgtgatcggcatgggccgtttgggtggagcagaacttggatacggttctgatgccgatgtgatgtttgtatgcgagccggtagccggtgtggaagagcatgaggccgtcacatggtctattgctatctgtgattccatgcggtcgaggcttgcgcagccttccggtgatccacctttggaggtggatctggggctgcgtcctgaagggagatctggtgcgattgtgcgcaccgttgattcctatgtgaagtactacgaaaagtggggtgaaacttgggagattcaggcgctgctgagggctgcgtgggttgctggtgatcgtgagctgggtattaagttcttggagtcgattgatcgtttccgctacccagttgacggggcaacgcaggcgcagcttcgtgaagttcgtcgaattaaggcgagggtggataatgagaggcttccgcgcggggctgatcgaaatacccataccaagctgggtcggggagcgttaactgacatcgagtggactgtgcagttgttgaccatgatgcatgctcatgagattccggagctgcacaatacgtcgacgttggaagttcttgaagtgctggaaaagcatcagattattaaccctgtgcaggtgcagacgcttcgggaagcgtggctgacggcaacggctgctaggaatgcgcttgtgctggtcaggggtaagagattagatcagttacctactcctggtccgcaccttgcgcaggtggctggtgcgtctggttgggatccaaatgagtaccaggagtatttggaaaactatctgaaagtgaccaggaagagtcgtcaggttgttgatgaagtcttctggggtgtggactctatggagcaacgtgagttttaggtaggtggtgggagccccaa

SEQ ID NO: 100 - protein, 1045 aa, Corynebacterium glutamicum
MSGPLRSERKVVGFVRDPLPKVGSLSLKSEHAQADLEHLGWRNVESLDLLWGLSGAGDPDVALNLLIRLYQALEAIGEDARNELDQEIRQDEKLRVRLFALLGGSSAVGDHLVANPLQWKLLKLDAPSREEMFQALLESVKAQPAVLEVEDFSDAHNIARDDLSTPGFYTASVTGPEAERVLKWTYRTLLTRIAAHDLAGTYPTDMRRKGGDPVPFSTVTMQLSDLADAALTAALAVAIANVYGEKPVDSALSVIAMGKCGAQELNYISDVDVVFVAEPANSKSTRTAAELIRIGSNSFFEVDAALRPEGKSGALVRSLDSHMAYYKRWAETWEFQALLKARPMTGDINLGQSYVDALSPLIWTASQRESFVTDVQAMRRRVLDNVPEDLRDRELKLGRGGLRDVEFAVQLLQMVHGRIDETLRVRSTVNALHVLVDQGYVGREDGHNLIESYEFLRLLEHRLQLERIKRTHLLPKPDDRMNMRWLARASGFTGSMEQSSAKAMERHLRKVRLQIQSLHSQLFYRPLLNSVVNLSADAIRLSPDAAKLQLAALGYLHPSRAYEHLTALASGASRKAKIQAMLLPTLMEWLSQTAEPDAGLLNYRKLSDASYDRSWFLRMLRDEGVVGQRLMRILGNSPYISELIISTPDFMKQLGDAASGPKLLATAPTQVVKAIKATVSRHESPDRAIQAARSLRRQELARIASADLLNMLTVQEVCQSLSLVWDAVLDAALDAEIRAALNDPQKPDQPLANISVIGMGRLGGAELGYGSDADVMFVCEPVAGVEEHEAVTWSIAICDSMRSRLAQPSGDPPLEVDLGLRPEGRSGAIVRTVDSYVKYYEKWGETWEIQALLRAAWVAGDRELGIKFLESIDRFRYPVDGATQAQLREVRRIKARVDNERLPRGADRNTHTKLGRGALTDIEWTVQLLTMMHAHEIPELHNTSTLEVLEVLEKHQIINPVQVQTLREAWLTATAARNALVLVRGKRLDQLPTPGPHLAQVAGASGWDPNEYQEYLENYLKVTRKSRQVVDEVFWGVDSMEQREF

SEQ ID NO: 101 - DNA, 861 bp, Corynebacterium glutamicum
  CDS (1)..(861): RXN03176
gagttggccgattacatcccggaactaaaatctgcggacccaaacccgctggcagtagccctgtgcaccgttaacggacacatctacagcgcaggcgatgacgacatcgaattcaccatgcaaagtatttccaagccatttgcctacgcactcgcactccaagaatgcggctttgatgaggtctctgcatccgtggccttggagccctccggtgaggccttcaacgaactttccctcgacggcgaaaaccgccccatgaaccccatgatcaacgccggcgcgatcgccatcaaccagctgatcaacggctccgattccaccgtggaagaccgcgtggaaaaaatccgacactacttctctgaacttgctggacgcgaactcaccatcgaccgcgtgcttgccgaatccgaactcgccggcgccgaccgcaacctctccatcgcccacatgctgcgcaattacggcgtcatcgaagacgaagcccacgacgccgtcctcagctacacgctgcaatgcgccatcaaagtaaccacgcgcgacctcgcagtcatgaccgccacgctcgccgccggcggcacacacccaattaccggcaagaagcttctcgacgcccgcgtctgccgcctcaccctctccgtcatggcttcagcaggcatgtacgacgaggcagggcagtggctctccaccgtaggcatccccgcgaaatcaggagtcgccggcggactcatcggcattctgccaggtcagctgggcatcgccacattttccccacgcctgaaccccaaaggcaacagcgtgcgcggcgtaaaaatattcaaacagctttccgacgacatgggcctccacctcatgtccaccgag

SEQ ID NO: 102 - protein, 287 aa, Corynebacterium glutamicum
ELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTE

SEQ ID NO: 103 - DNA, 861 bp, Corynebacterium glutamicum; identical to SEQ ID NO: 101
  CDS (1)..(861): FRXA02879

SEQ ID NO: 104 - protein, 287 aa, Corynebacterium glutamicum; identical to SEQ ID NO: 102

SEQ ID NO: 105 - DNA, 1155 bp, Corynebacterium glutamicum
  CDS (101)..(1132): RXA00278
ggccacggagttggtgtccgtcatggtgatgattctgtctgtcgtttctgtgttggctttgtgggtcggcatccgcccccgtttgcaggagtacttataaatgcacgcttttcgacgcccccctccactcaccacgcgagtcggcgctgcattgctggccgcaacgctgcttgcttcctgcactccaacacctgtggaaccggcagaaaccttgactgctttggatcccgatgccggtccaccactgccaccggattcttcgattgaagctcccggtgaaaaagagcccattgtggaagtaatagagaattggccaggttctttacgcccggatgatctgacccctgaggagcgggtacctggcatcgtcaaccggggtcgcatcattgtgggtgtggatcaatcgcaaaacttgctcagtttccgtgatccggtgactggtgagctgcgcggttttgaagtggaattagcgagggaaatttcccgcgacattttcggtgaccccaataaggtggatttccgattcgtcggctcgtccgaccgtctgcgttcccttgaccaaggtgatgtagatattgtgattcgttccgtcacgatcaccgacgaacgcgccaaattggtggaattttccacaccgtacctgcgcacccaaacccgcatgttgaccatggaatcttcaggaatcacgtccatcgcagatctacccggccacaccatttgtgtcaccgatggctccacttcattgcagcgagcccgcaccattgcgccggaggcctcaatcttaaaaactcgcaattggtccgattgtctcatggcgttgcagcagcatcaggctcaggtcattttgggcgatgatgtcattttgtccggcatcgcagcacaggatccctacaccgagattcttgatacctccctcgattcccattcctatggagtggcagcggcatcgaccactgctgaaacagactcttcggggttgattcggcaggtaaactacacaattgaacggatccgcacagaccgcatgtggtggacaatgttcgacgattggttcggaccttatctctggtcctacggtccaccacagctgcagtacatgccagaggaagaagggacagaaaacgatgaaggataatgaagatttcgatccagatt

SEQ ID NO: 106 - protein, 344 aa, Corynebacterium glutamicum
MHAFRRPPPLTTRVGAALLAATLLASCTPTPVEPAETLTALDPDAGPPLPPDSSIEAPGEKEPIVEVIENWPGSLRPDDLTPEERVPGIVNRGRIIVGVDQSQNLLSFRDPVTGELRGFEVELAREISRDIFGDPNKVDFRFVGSSDRLRSLDQGDVDIVIRSVTITDERAKLVEFSTPYLRTQTRMLTMESSGITSIADLPGHTICVTDGSTSLQRARTIAPEASILKTRNWSDCLMALQQHQAQVILGDDVILSGIAAQDPYTEILDTSLDSHSYGVAAASTTAETDSSGLIRQVNYTIERIRTDRMWWTMFDDWFGPYLWSYGPPQLQYMPEEEGTENDEG

SEQ ID NO: 107 - DNA, 1035 bp, Corynebacterium glutamicum
  CDS (101)..(1012): RXA00727
ttattgcaccatggcaggtagtattttgcccatgattgagagtttcacccgattgcgaatttcgcagacaccgcctctgaaacggctactgcatagcactttgcgtttccccaaaatccccaagcgcgctgtagcggcgaccgtcggcatcgtggcaacctcattcaccttggcttcttgtgtcaccaatgaggagcagggcaacccagatggctgggagcagatcgttccagatcctgtaccggagattcaggcgatggttcccgaagctctggctcagcgcggtgtgctcaccgccggtgccaacccacctttcccaccgtttgagtttaaagattccgatggtcagattatcggtgtggaaatggacctcgtgcgtgcaatggcgggggtgatgggcttggagttcagccctcaggagcaggatttctccctcatccttccatcggttcaagctggcacccttgatatcggagcctctggcttcactgacaacgaggaacgccgcgagaactttgatttcatcgatttcctcttcgcaggtgtgcagtgggcgcaggcaactgatcgtgaaaccccaatcgatccggaaaacgcctgtggtctcaccgttgctgtacagcgcacaaccgtggcagagaccgacgatgtccgtcctcgctcagctcaatgtgaagccgaaggcaaagagccgatcaccattttgtcttatgaaaccgcagatactgcagctaccgcattgatcctgggacgcgcagacgcacttgctgcggactcccctgtttcagcttgggctgcagagcgctccgaaggccgcatcgaagttgtgggcgatatgtacttggctgcgccatttggtttcgcattcccgttggaatctgacctcaccccagcagcagctgcggcgttccaacacttgattgacaccggcgattaccagcgcatcatggcgcaatggggcattgaagaaggccttcttgatgaggccctgatcaacgaacagccactcaactagagccttccagcaactaaaaa

SEQ ID NO: 108 - protein, 304 aa, Corynebacterium glutamicum
LRFPKIPKRAVAATVGIVATSFTLASCVTNEEQGNPDGWEQIVPDPVPEIQAMVPEALAQRGVLTAGANPPFPPFEFKDSDGQIIGVEMDLVRAMAGVMGLEFSPQEQDFSLILPSVQAGTLDIGASGFTDNEERRENFDFIDFLFAGVQWAQATDRETPIDPENACGLTVAVQRTTVAETDDVRPRSAQCEAEGKEPITILSYETADTAATALILGRADALAADSPVSAWAAERSEGRIEVVGDMYLAAPFGFAFPLESDLTPAAAAAFQHLIDTGDYQRIMAQWGIEEGLLDEALINEQPLN

SEQ ID NO: 109 - DNA, 1962 bp, Corynebacterium glutamicum
  CDS (101)..(1939): RXA02139
tcaggaggatttttcaatcatgtgcggccttcttggcatattgactgcaaatgggaacgctgaagcattcgttcctgcactcgagcgggccttgccatgcatgcgccaccgtggtcctgacgatgccggcacttggcatgacgccgatgcagcgtttggattcaaccgcctctccatcattgatattgcacactcccaccaaccactgcgttggggacctgcggatgaacccgaccgctacgcaatgactttcaacggtgagatctacaactacgttgagctgcgtaaagagctctcggatttgggatatgcctttaatacttctggcgatggcgagccaattgttgtcggtttccaccactggggcgagtccgtggtcgagcatctccgcggaatgttcggcattgccatttgggatacaaaggaaaagtcgcttttccttgcgcgtgatcagttcggcattaagccactgttctacgcaaccaccgagcatggcaccgtgttctcctcagagaagaagaccatcttggagatggccgaggagatgaatctagatctgggccttgataagcgcaccattgagcactacgtggacttgcagtacgtgcccgagccagatacccttcacgcgcagatttcccgcttggagtcaggctgcaccgcaacagttcgtccgggcggcaagctggaacagaagcgttacttcaagcctcagttcccagtacagaaggtcgtaaagggtaaggagcaggacctcttcgatcgcattgcccaggtgttggaggatagcgtcgaaaagcatatgcgtgccgacgtgaccgtaggctcgttccttttcggcggcattgactcaaccgcaattgcggcgcttgcaaagcgccacaaccctgacctgctcaccttcaccaccggtttcgagcgtgaaggctactcggaggtcgatgtggctgcggagtccgccgctgcgattggcgctgagcacatcgtgaagattgtctcgcctgaggaatacgccaacgcgattcctaagatcatgtggtacttggatgatcctgtagctgacccatcattggtcccgctgtacttcgtggcagcggaagcacgtaagcacgtcaaggttgtgctgtctggcgagggcgcagatgagctgttcggtggatacaccatttacaaggagccgctatcgcttgctccatttgagaagatcccttccccactacgtaaaggcctgggaaagctcagcaaggttctgccagacggcatgaagggcaagtcccttcttgagcgtggctccatgaccatggaagagcgctactacggcaacgctcgctccttcaatttcgagcagatgcaacgcgttattccatgggcaaagcgcgaatgggaccaccgcgaagtcactgcgccgatctacgcacagtcccgcaactttgatccagtagcccgcatgcaacacctggatctgttcacctggatgcgcggcgacatcctggtcaaggctgacaagatcaacatggcgaactcccttgagctgcgagttccattcttggataaggaagttttcaaggttgcagagaccattccttacgacctgaagattgccaacggtaccaccaagtacgcgctgcgcagggcactcgagcagattgttccgcctcacgttttgcaccgcaagaagctgggcttccctgttcccatgcgccactggcttgccggcgatgagctgttcggttgggcgcaggacaccatcaaggaatccggtactgaagatatcttcaacaagcaggctgtgctggatatgctgaacgagcaccgcgatggcgtgtcagatcattcccgtcgactgtggactgttctgtcatttatggtgtggcacggcatttttgtggaaaaccgcattgatccacagattgaggaccgctcctacccagtcgagctttaagtcttaaagcctaaaccccc

SEQ ID NO: 110 - protein, 613 aa, Corynebacterium glutamicum
MRHRGPDDAGTWHDADAAFGFNRLSIIDIAHSHQPLRWGPADEPDRYAMTFNGEIYNYVELRKELSDLGYAFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLFGGIDSTAIAALAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 111 - DNA, 1284 bp, Corynebacterium glutamicum
  CDS (101)..(1261): RXN00116
cgcggcacgcacgctgggggcaagcgtcgacaagcacaaactttttgcttaattgaatcctttgcgcaccaatcaatgggggatcaaatatagtagctgcatgagtaatgacttcgtcgtttctaggcttagaccctttggtgaaacgatttttgcaaccatgacccagcgagctgttgaggcgggtgcaatcaatcttggtcagggctttcctgatgaggatggtcctcgtcggatgttagagatcgcgtcggagcagattctcgggggaaataatcagtattcggcggggcgtggggatgcttcgttgagggcagctgtggctcgtgatcatttggagaggtttgatctggagtacaaccctgattcggaggtgttgatcacggtgggggccactgaggcgattacggcgactgtgttgggtttggtggagcctggggatgaagtgatcgttttggaaccgtattacgatgcgtatgcggcggctattgcgttggcgggggcgacgcgggtggcggttcctttgcaggaggtggagaactcgtgggatgtggatgtcgataagttgcatgcggcggtgactaagaagacgcggatgattatcgttaattcgccgcataatccgacgggttcggtgttttctaagaaggcgttgaagcagttggcgggtgttgctcgtgcgtatgacttgttggtgttgtcagatgaggtgtatgagcatcttgtttttgatgatcagaagcatgtgagtgtcgcgaagctgcccggtatgtgggatcgcacggtgacggtgtcgtcggcggcgaaaacgttcaatgtgactggttggaagacggggtgggcgttggcaccggagccgttgttggaggcggtgttgaaggcgaagcagtttatgtcttatgtgggggctacaccttttcagccggctgtggcgcatgcgattgaacatgagcagaagtgggtgtcaaagatgtctaaggggcttgagctcaagcgggatattttgcgtactgcgttagataaggcggggctgaagactcatgacagtatgggcacgtatttcatcgttgcggatattggggatcgtgatggtgcggagttctgttttgagttgattgagaaggttggggtggcggcgattccggtgcaggcgtttgtggatcatccgaagaagtggtcgtcgaaggttcgttttgcgttttgcaaaaaagaagagacgctccgcgaagctgcggagcgtctcaaggggattaagaaactatagtttgaacaggttgttggggg

SEQ ID NO: 112 - protein, 387 aa, Corynebacterium glutamicum
MSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 113 - DNA, 607 bp, Corynebacterium glutamicum
  CDS (101)..(607): FRXA00116
tttgcgcaccaatcaatgggggatcaaatatagtagctgcatgagtaatgacttcgtcgtttctaggcttagaccctttggtgaaacgatttttgcaaccatgacccagcgagctgttgaggcgggtgcaatcaatcttggtcagggctttcctgatgaggatggtcctcgtcggatgttagagatcgcgtcggagcagattctcgggggaaataatcagtattcggcggggcgtggggatgcttcgttgagggcagctgtggctcgtgatcatttggagaggtttgatctggagtacaaccctgattcggaggtgttgatcacggtgggggccactgaggcgattacggcgactgtgttgggtttggtggagcctggggatgaagtgatcgttttggaaccgtattacgatgcgtatgcggcggctattgcgttggcgggggcgacgcgggtggcggttcctttgcaggaggtggagaactcgtgggatgtggatgtcgataagttgcatgcggcggtgactaagaagacgcggatgattatcgttaattcgccgcataatccgacgggttcggtgttttctaagaaggcgttgaagcagttggcg

SEQ ID NO: 114 - protein, 169 aa, Corynebacterium glutamicum
MTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLA

SEQ ID NO: 115 - DNA, 1230 bp, Corynebacterium glutamicum
  CDS (101)..(1207): RXN00618
gctgcattagagggtcgtatctcgatctaaaagcagtacgcagataggcttgtctcttatgaagccaagcactagaagcaatgttcagccgtttcgcgtcatgcagatgttggaccgagtccaccgtcgcaggcgcgaaggcaaagacaccttaatgttctgcgctggccagccgtcaactggtgcgccagaagcagtcatcgaagaagcagagatcgctcttcgctcgggtcctttgggatacaccgaggtgattggtgatcgtgagttccgtgaacgcatcgccgattggcactctgctacttatgacgtagacaccaaccctgacaatgttattgtcaccaccggttcttcaggtggattcgtggcatcgtttatcgccaccttggatcacggggattatgtggcaatgcctaccccggggtacccggcatatcgcaatattctggaatctttgggggcgaaggttctgaacctgcgctgtactgcagagactcgtttccagccaaccgctcaaatgttggaggaactgccacacaagccgaaggctgttattgtcaccagcccaggaaacccaacgggcaccatcattgatccggaagagctagagcgcatcgccaagtggtgcgatgacaatgatgctgttcttatctctgatgaggactaccacggcatgagctttggtcgtccgctggcaactgcgcatcagttttccaagaacgccatcgtggtgggtaccttgtccaagtacttctccatgacgggttggcgcgtgggttggatcatcgttccagatgagctggtcacaccgattgaaaacctgcaggcttctctttccttgtgtgctcctgccatcgggcaggctgcgggacgcgcagccttcactttggaggctggggccgaacttgatgcccacgttgaagcgtatcgcgaggcccgggaggtgttcgtcgataagctccctgaaatcgggcttggcactttcgccgacccggatggcggcctgtatttgtgggtcgatgtttctgcatacaccgatgattcagaggaatgggcattgcgtttgctcgatgaagcgggcgtggccgtcgcgccgggtgttgattttgatcctgaggaaggccacaagtggattcgtttgagcctgtgcgcgtcaaaggaagacaccattgaaggtgtgcgcaaaatcggagaattcatcaaaaaatagcagcgactaggttagtttcg

SEQ ID NO: 116 - protein, 369 aa, Corynebacterium glutamicum
MQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 117 - DNA, 657 bp, Corynebacterium glutamicum
  CDS (101)..(634): FRXA00618
cccaacgggcaccatcattgatccggaagagctagagcgcatcgccaagtggtgcgatgacaatgatgctgttcttatctctgatgaggactaccacggcatgagctttggtcgtccgctggcaactgcgcatcagttttccaagaacgccatcgtggtgggtaccttgtccaagtacttctccatgacgggttggcgcgtgggttggatcatcgttccagatgagctggtcacaccgattgaaaacctgcaggcttctctttccttgtgtgctcctgccatcgggcaggctgcgggacgcgcagccttcactttggaggctggggccgaacttgatgcccacgttgaagcgtatcgcgaggcccgggaggtgttcgtcgataagctccctgaaatcgggcttggcactttcgccgacccggatggcggcctgtatttgtgggtcgatgtttctgcatacaccgatgattcagaggaatgggcattgcgtttgctcgatgaagcgggcgtggccgtcgcgccgggtgttgattttgatcctgaggaaggccacaagtggattcgtttgagcctgtgcgcgtcaaaggaagacaccattgaaggtgtgcgcaaaatcggagaattcatcaaaaaatagcagcgactaggttagtttcg

SEQ ID NO: 118 - protein, 178 aa, Corynebacterium glutamicum
MSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 119 - DNA, 385 bp, Corynebacterium glutamicum
  CDS (101)..(385): FRXA00627
gctgcattagagggtcgtatctcgatctaaaagcagtacgcagataggcttgtctcttatgaagccaagcactagaagcaatgttcagccgtttcgcgtcatgcagatgttggaccgagtccaccgtcgcaggcgcgaaggcaaagacaccttaatgttctgcgctggccagccgtcaactggtgcgccagaagcagtcatcgaagaagcagagatcgctcttcgctcgggtcctttgggatacaccgaggtgattggtgatcgtgagttccgtgaacgcatcgccgattggcactctgctacttatgacgtagacaccaaccctgacaatgttattgtcaccaccggttcttcaggtggattcgtggcatcgtttatcgccacc

SEQ ID NO: 120 - protein, 95 aa, Corynebacterium glutamicum
MQMLDRVHRRRREGKDTLMFCAGQPSTGAPEAVIEEAEIALRSGPLGYTEVIGDREFRERIADWHSATYDVDTNPDNVIVTTGSSGGFVASFIAT

SEQ ID NO: 121 - DNA, 1434 bp, Corynebacterium glutamicum
  CDS (101)..(1411): RXA02550
gatcttaggcagccgtgggattacacccttttagagctagaacagtaaaaattcacccaatagctttcaactacgcacacaaagtggcaacattgagcgggtgactacagacaagcgcaaaacctctaagaccaccgacaccgccaacaaggctgtgggcgcggatcaggcagcgcgtcccactcggcgaacaactcgccgcatcttcgatcagtcggagaagatgaaggacgtgctgtacgagatccgtggcccggtggccgcggaggcggaacgcatggagcttgatgggcataacatcttaaagctcaacacgggaaatccagccgtgttcggattcgatgcccccgacgtgattatgcgtgacatgatcgccaaccttccaacttcccaagggtattccacctccaaaggcattattccggcccggcgagcagtggtcacccgctacgaagttgtgcccggattcccccacttcgatgttgatgatgtgttcttaggcaacggtgtctcagaactaatcaccatgaccacccaagcactcctcaacgacggcgatgaagttcttatccccgcaccggactacccactgtggactgccgcaacctccctggctggtggtaagcctgtgcactacctctgtgatgaggaagatgactggaacccatccatcgaagacatcaagtccaaaatctcagagaaaaccaaagctattgtggtgatcaaccccaacaaccccacgggagctgtctacccgcgccgggtgttggaacaaatcgtcgagattgcacgcgagcatgacctgctgattttggccgatgaaatctacgaccgcattctctacgatgatgccgagcacatcagcctggcaacccttgcaccagatctcctttgcatcacatacaacggtctatccaaggcataccgcgtcgcaggataccgagctggctggatggtattgactggaccaaagcaatacgcacgtggatttattgagggcctcgaactcctcgcaggcactcgactctgcccaaatgtcccagctcagcacgctattcaggtagctctgggtggacgccagtccatctacgacctcactggcgaacacggccgactcctggaacagcgcaacatggcatggacgaaactcaacgaaatcccaggtgtcagctgtgtgaaaccaatgggagctctatacgcgttccccaagctcgaccccaacgtgtacgaaatccacgacgacacccaactcatgctggatcttctccgtgccgagaaaatcctcatggttcagggcactggcttcaactggccacatcacgatcacttccgagtggtcaccctgccatgggcatcccagttggaaaacgcaattgagcgcctgggtaacttcctgtccacttacaagcagtagtagttgttaggattcaccac

SEQ ID NO: 122 - protein, 437 aa, Corynebacterium glutamicum
VTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 123 - DNA, 1701 bp, Corynebacterium glutamicum
  CDS (101)..(1678): RXA02193
cccccgaaaatgtagtgggtagttccacactgcctcttacaagtacgtaggataatccacagcaccattgtgatttccttcaacttgtgagaggcagtacatgtctaagacgagcaacaagtcttcagcagactcaaagaatgacgcaaaagccgaagacattgtgaacggcgagaaccaaatcgccacgaatgagtcgcagtcttcagacagcgctgcagtttcggaacgtgtcgtcgaaccaaaaaccacggttcagaaaaagttccgaatcgaatcggatctgcttggtgaacttcagatcccatcccacgcatattacggggtgcacacccttcgtgcggtggacaacttccaaatctcacgaaccaccatcaaccacgtcccagatttcattcgcggcatggtccaggtgaaaaaggccgcagctttagcaaaccgccgactgcacacacttccagcacaaaaagcagaagcaattgtctgggcttgtgatcagatcctcattgaggaacgctgtatggatcagttccccatcgatgtgttccagggtggcgcaggtacctcactgaacatgaacaccaacgaggttgttgccaaccttgcacttgagttcttaggccatgaaaagggcgagtaccacatcctgcaccccatggatgatgtgaacatgtcccagtccaccaacgattcctacccaactggtttccgcctgggcatttacgctggactgcagaccctcatcgctgaaattgatgagcttcaggttgcgttccgccacaagggcaatgagtttgtcgacatcatcaagatgggccgcacccagttgcaggatgctgttcccatgagcttgggcgaagagttccgagcattcgcgcacaacctcgcagaagagcagaccgtgctgcgtgaagctgccaaccgtctcctcgaggtcaatcttggtgcaaccgcaatcggtactggtgtgaacactccagcaggctaccgccaccaggttgtcgctgctctgtctgaggtcaccggactggaactaaagtccgcacgtgatctcatcgaggctacctctgacaccggtgcatatgttcatgcgcactccgcaatcaagcgtgcagccatgaaactgtccaagatctgtaacgatctacgtctgctgtcttctggtcctcgtgctggcttgaacgaaatcaacctgccaccacgccaggctggttcctccatcatgccagccaaggtcaacccagtgatcccagaagtggtcaaccaggtctgcttcaaggtcttcggtaacgatctcaccgtcaccatggctgcggaagctggccagttgcagctcaacgtcatggagccagtcattggcgaatccctcttccagtcactgcgcatcctgggcaatgcagccaagactttgcgtgagaagtgcgtcgtaggaatcaccgccaacgctgatgtttgccgtgcttacgttgataactccatcgggattatcacttacctgaacccattcctgggccacgacattggagatcagatcggtaaggaagcagccgaaactggtcgaccagtgcgtgaactcatcctggaaaagaagctcatggatgaaaagacgctcgaggcagtcctgtccaaggagaacctcatgcacccaatgttccgcggaaggctctacttggagaactaatccaagatctcgtctgatac

SEQ ID NO: 124 - protein, 526 aa, Corynebacterium glutamicum
MSKTSNKSSADSKNDAKAEDIVNGENQIATNESQSSDSAAVSERVVEPKTTVQKKFRIESDLLGELQIPSHAYYGVHTLRAVDNFQISRTTINHVPDFIRGMVQVKKAAALANRRLHTLPAQKAEAIVWACDQILIEERCMDQFPIDVFQGGAGTSLNMNTNEVVANLALEFLGHEKGEYHILHPMDDVNMSQSTNDSYPTGFRLGIYAGLQTLIAEIDELQVAFRHKGNEFVDIIKMGRTQLQDAVPMSLGEEFRAFAHNLAEEQTVLREAANRLLEVNLGATAIGTGVNTPAGYRHQVVAALSEVTGLELKSARDLIEATSDTGAYVHAHSAIKRAAMKLSKICNDLRLLSSGPRAGLNEINLPPRQAGSSIMPAKVNPVIPEVVNQVCFKVFGNDLTVTMAAEAGQLQLNVMEPVIGESLFQSLRILGNAAKTLREKCVVGITANADVCRAYVDNSIGIITYLNPFLGHDIGDQIGKEAAETGRPVRELILEKKLMDEKTLEAVLSKENLMHPMFRGRLYLEN

SEQ ID NO: 125 - DNA, 1098 bp, Corynebacterium glutamicum
  CDS (101)..(1075): RXA02432
cacgtgattcatttgtgaccaacaaccgaaactgagccagaagactgtcaatcccctgctgtgcacataacaactgcagctagttgatacgctagagcgcatgtcgaagcagcactccacaccattaaacaatgatgaagaacacacttccgctcctcaaaaggttgcggtaatcaccacgggcggaaccatcgcctgtacttccgacgcaaatgggcatctgcttcccaccgtcagcggtgcagacctgcttgcgccaatcgcaccacggttcaatggagcgcagatcgctttcgaaatccacgaaatcaaccgccttgattcctcctccatgacgtttgaggatctcgattccatcatcgccacggttcataaggtgttggaggatccggatgttgttggcgtagtagttacccacggcaccgattccatggaagagtccgccatcgccgtagacaccttccttgatgatccccgcccagtcattttcaccggcgcccaaaaacccttcgatcatcccgaagccgacggcccaaacaaccttttcgaagcctgcctcatcgcatccgacccctccgctcgcggaattggtgcactcattgtcttcggtcacgccgtcatccctgctcgcggctgcgttaaatggcacacctctgatgagctggcgtttgcaaccaacggccctgaagaaccagagcgccccgatgcgctgcccgtagctaaattggcggatgtctctgtcgaaatcatccccgcataccctggtgccaccggcgcaatggtggaagctgccatcgctgccggtgctcaaggacttgtagtggaagcaatgggatcaggcaatgttggttcccgcatgggtgatgccctaggtaaagcacttgacgctggaattcccgtggtgatgagcactagggttcctcgtggtgaagtatccggagtgtatggcggtgcaggtggaggtgcgactttggctgcgaagggcgctgtgggatctcgctacttcagagctggtcaggcacgtattttgctcgcgattgccattgcgacgggcgcacatccggtgacgctttactaatttcgcccttggtcttgcat

SEQ ID NO: 126 - protein, 325 aa, Corynebacterium glutamicum
MSKQHSTPLNNDEEHTSAPQKVAVITTGGTIACTSDANGHLLPTVSGADLLAPIAPRFNGAQIAFEIHEINRLDSSSMTFEDLDSIIATVHKVLEDPDVVGVVVTHGTDSMEESAIAVDTFLDDPRPVIFTGAQKPFDHPEADGPNNLFEACLIASDPSARGIGALIVFGHAVIPARGCVKWHTSDELAFATNGPEEPERPDALPVAKLADVSVEIIPAYPGATGAMVEAAIAAGAQGLVVEAMGSGNVGSRMGDALGKALDAGIPVVMSTRVPRGEVSGVYGGAGGGATLAAKGAVGSRYFRAGQARILLAIAIATGAHPVTLY

SEQ ID NO: 127 - DNA, 775 bp, Corynebacterium glutamicum
  CDS (101)..(775): RXN03003
tcgatgatctgggctccccaggtggtgcggctaagcttggaccacaagattttgatcacccaatgatcgctgcgctgccgcctcaggcataatctaacgcatgacctctcgcaccccgcttgtttctgttcttcctgattttccgtgggattcgctcgcttccgcaaaagccaaagctgcgtctcacccggatgggatcgtgaatctttctgttggcactccggttgatccggtcgcgcccagcattcagatcgcgttggcagaagcagcggggttttcgggttaccctcaaaccatcggcaccccggaactccgcgcagccatcaggggcgcgcttgagcggcgctacaacatgacaaagcttgtcgacgcctccctcctccccgtcgtgggtaccaaggaggcaattgcccttcttccattcgcgttgggtatttccggcaccgttgtcatcccagagattgcgtacccaacctacgaagtcgctgtcgtggccgcaggatgcaccgtgttgcgttctgattcgctgtttaagctcggcccgcagatcccgtcgatgatgtttatcaactcaccatccaaccccacaggcaaggttctgggcatcccacacttgcgcaaggttgtgaagtgggcgcaggaaaacaacgtgatcctcgcagctgatgaatgctacttgggtcttggctgggacgatgaaaacccaccgatctcaattttggatccacgtgtctgcgatggcgaccacaccaacttgatcgccattcactcgctg

SEQ ID NO: 128 - protein, 225 aa, Corynebacterium glutamicum
MTSRTPLVSVLPDFPWDSLASAKAKAASHPDGIVNLSVGTPVDPVAPSIQIALAEAAGFSGYPQTIGTPELRAAIRGALERRYNMTKLVDASLLPVVGTKEAIALLPFALGISGTVVIPEIAYPTYEVAVVAAGCTVLRSDSLFKLGPQIPSMMFINSPSNPTGKVLGIPHLRKVVKWAQENNVILAADECYLGLGWDDENPPISILDPRVCDGDHTNLIAIHSL

SEQ ID NO: 129 - DNA, 1206 bp, Corynebacterium glutamicum
  CDS (101)..(1183): RXN00508
agccacgtgtttaaggatagttgaaagcgtggggcaatactggcactaaccccggcaccaatcgtatttctgtccgcggttggtggcacaatagttcaacatgaacttgctgaccaccaaaattgacctggatgccatcgcccataacacgagggtgcttaaacaaatggcgggtccggcgaagctgatggcggtggtgaaggcgaatgcatataaccatggcgtagagaaggtcgctccggttattgctgctcatggtgcggatgcgtttggtgtggcaactcttgcggaggctatgcagttgcgtgatatcggcatcagccaagaggttttgtgttggatttggacaccggagcaggatttccgcgccgccattgatcgcaatattgatttggctgttatttctcccgcgcatgccaaagccttgatcgaaactgatgcggagcatattcgggtgtccatcaagattgattctgggttgcatcgttcgggtgtggatgagcaggagtgggagggcgtgttcagcgcgttggctgctgccccgcacattgaggtcacgggcatgttcacgcacttggcgtgcgcggatgagccagagaatccggaaactgatcgccaaattattgcttttcgacgcgcccttgcgctcgcccgcaagcacgggcttgagtgcccggtcaaccacgtatgcaactcacctgcattcttgactcgatctgatttacacatggagatggtccgaccgggtttggccttttatgggttggaacccgtggcgggactggagcatggtttgaagccggcgatgacgtgggaggcgaaggtgagcgtcgtaaagcaaattgaagctggacaaggcacttcctatggcctgacctggcgcgctgaggatcgcggctttgtggctgtggtgcctgcgggctatgccgatggcatgccgcggcatgcccaggggaaattctccgtcacgattgatggcctggactatccgcaggttgggcgcgtatgcatggatcagttcgttatttctttgggcgacaatccacacggcgtggaagctggggcgaaggccgtgatattcggtgagaatgggcatgacgcaactgattttgcggagcgtttagacaccattaactatgaggtagtgtgccgaccaaccggccgaactgtccgcgcatatgtttaagtgaatacgtttaaggagca

SEQ ID NO: 130 - protein, 361 aa, Corynebacterium glutamicum
MNLLTTKIDLDAIAHNTRVLKQMAGPAKLMAVVKANAYNHGVEKVAPVIAAHGADAFGVATLAEAMQLRDIGISQEVLCWIWTPEQDFRAAIDRNIDLAVISPAHAKALIETDAEHIRVSIKIDSGLHRSGVDEQEWEGVFSALAAAPHIEVTGMFTHLACADEPENPETDRQIIAFRRALALARKHGLECPVNHVCNSPAFLTRSDLHMEMVRPGLAFYGLEPVAGLEHGLKPAMTWEAKVSVVKQIEAGQGTSYGLTWRAEDRGFVAVVPAGYADGMPRHAQGKFSVTIDGLDYPQVGRVCMDQFVISLGDNPHGVEAGAKAVIFGENGHDATDFAERLDTINYEVVCRPTGRTVRAYV

SEQ ID NO: 131 - DNA, 1152 bp, Corynebacterium glutamicum
  CDS (101)..(1129): RXN00636
tcatgggattcagcaaggcggccacccgaaccgtctttggtggaggagtaggagcgatgatcgatctggcccgttcgaacataaggaatattcctactccatgatgattgatacacctgctgttctcattgaccgcgagcgcttaactgccaacatttccaggatggcagctcacgccggtgcccatgagattgccctgcgtccgcatgtgaaaacgcacaaaatcattgaaattgcgcagatgcaggtcgacgccggtgcccgagggatcacctgcgcaaccattggcgaggcggaaatttttgccggcgcaggttttacggacatctttattgcatatccgctgtatctaaccgatcatgcagtgcaacgcctgaacgcgatccccggagaaatttccattggcgtggattcggtagagatggcacaggcgacggcgggtttgcgggaagatatcaaggctctgattgaagtggattcgggacatcgtagaagtggagtcacggcgactgcttcagaattgagtcagatccgcgaggcgctgggcagcaggtatgcaggagtgtttacttttcctgggcattcttatggcccgggaaatggtgagcaggcagcagctgatgagcttcaggctctaaacaacagcgtccagcgacttgctggcggcctgacttctggcggttcctcgccgtctgcgcagtttacagacgcaatcgatgagatgcgaccaggcgtgtatgtgtttaacgattcccagcagatcacctcgggagcatgcactgagaagcaggtggcaatgacggtgctgtctactgtggtcagccgaaatgtgtcagatcgtcggatcattttggatgcgggatccaaaatcctcagcactgataaaccagcatggattgatggcaatggttttgttctggggaatcctgaagcccgaatctctgctttgtcggagcatcacgcaaccattttctggccagataaagtgctacttccagtaatcggggagcagctcaacatcgtgcccaaccatgcctgcaacgtgattaatttggtggatgaggtctacgttcgggaagccgatggcactttccgtacctggaaggtagttgcccgcggcagaaacaattagggaaacctcttgaccttcac

SEQ ID NO: 132 - protein, 343 aa, Corynebacterium glutamicum
MMIDTPAVLIDRERLTANISRMAAHAGAHEIALRPHVKTHKIIEIAQMQVDAGARGITCATIGEAEIFAGAGFTDIFIAYPLYLTDHAVQRLNAIPGEISIGVDSVEMAQATAGLREDIKALIEVDSGHRRSGVTATASELSQIREALGSRYAGVFTFPGHSYGPGNGEQAAADELQALNNSVQRLAGGLTSGGSSPSAQFTDAIDEMRPGVYVFNDSQQITSGACTEKQVAMTVLSTVVSRNVSDRRIILDAGSKILSTDKPAWIDGNGFVLGNPEARISALSEHHATIFWPDKVLLPVIGEQLNIVPNHACNVINLVDEVYVREADGTFRTWKVVARGRNN

SEQ ID NO: 133 - DNA, 879 bp, Corynebacterium glutamicum
  CDS (101)..(856): RXA02536
aagaagtgatcacgcgaacctgtgtataacttgcctcaaagcgcctaggctgtggattatgcgtattgccttgcttcagatctcgacgaattccgataagatggacaacttcgccctgctgcgtgatgctgctgaaaaagctgcggaacagggggctcgggtgttggtgtttccggaggcgacttcgcaaagctttggtacgggaaggcttgatactcaggcggaggagctcgatggcgaattctccaccgcggtacgaaaattagccgatgagctggacgttgtcatcgttgcgggcatgttcacccctgctgacaccgtgcagcgcggtgaaaaaacgatctcgcgcgtcaacaacaccgtgctgattagtggcgctggattgcatcagggatacaacaaaattcacacatatgacgcgttcggttatagggaatccgacactgtgaaaccgggcgatgagctggttgtattcgaggtcgacgatattaaatttggtgtggcgacatgctacgatattcgattcccagaacagttcaaagacctcgcccgcaacggtgcacagataattgtggttcccacgtcgtggcaagacggtcctggaaaattagaacaatgggaagtcctccctcgcgcgcgtgcactggattccacctgctggatcgtagcgtgtgggcaagcgcgacttccagaagaattacgcgatgaacgaaaaggccctacggggattggtcattccatggtgacaaacccacacggtgaagtaattgctagcgcgggttatgagccagaaatgttgatcgcggatattgatgtcagcggtttggccaaaattcgggaggcattgcctgttctttaaccactgtctaaggaatcact

SEQ ID NO: 134 - protein, 252 aa, Corynebacterium glutamicum
MDNFALLRDAAEKAAEQGARVLVFPEATSQSFGTGRLDTQAEELDGEFSTAVRKLADELDVVIVAGMFTPADTVQRGEKTISRVNNTVLISGAGLHQGYNKIHTYDAFGYRESDTVKPGDELVVFEVDDIKFGVATCYDIRFPEQFKDLARNGAQIIVVPTSWQDGPGKLEQWEVLPRARALDSTCWIVACGQARLPEELRDERKGPTGIGHSMVTNPHGEVIASAGYEPEMLIADIDVSGLAKIREALPVL

SEQ ID NO: 135 - DNA, 1635 bp, Corynebacterium glutamicum
  CDS (101)..(1612): RXS00870
caagacggcgatgtcgccgccgctgttgataccgcagcgcgacttgttcacacagatattcaacaattcacttcgcagagcatttaaggaatttacacacatgtctgaaccacaaaccatctcgcactggattgacggcgcgatttccccatccacttccggcaagaccgctcctgtctacaatcctgcaactggccaggtcaccgccaatgttgcgctggctagccaggaagagatcgatgccaccatcgcttctgccaccaaggctgctaagacgtggggcaacctgtctatcgctaagcgccaagctgtgcttttcaacttccgtgagctgctgaatgctcgcaagggtgagctggcggagatcatcactgcagagcacggcaaggtcttgtccgatgccatgggtgaaatcctgcgcggccaggaagtcgtggagcttgctaccggtttcccacacctgcttaaaggtgcgttcaacgagaacgtctccaccggcattgatgtgtattccttgaagcagccactgggtgttgtcggtatcatcagcccgttcaacttccctgcgatggtgccgatgtggtttttcccaatcgcaatcgctgcaggcaacgcagttattttgaagccttcagagaaggatccttcggcagcgctgtggatggctcagatctggaaggaagctggtcttccagacggcgtattcaacgtgctccagggcgacaagctggctgttgatggtttgctgaacagccctgatgtctctgcgatttccttcgtgggttccaccccaatcgcaaagtacatctacgagacttccgcgaagaacggcaagcgcgtccaggcgttgggcggcgcgaagaaccacatgctggtgctgccagatgctgatctggatctggttgccgatcaggcaatcaacgcaggttacggcgctgccggtgagcgttgcatggctgtttctgtggtcttggctattgaatctgttgccgacgagctcattgagaagatcaaggagcgcatcgacaccctgcgcatcggcaacggtgccggcgacgagcagggcgagccgcacctgggcccactaatcaccgacgtccaccgcgacaaggtcgcttcttatgtcgacatcgctgaggccgacggcgccaagatcatcgtggacgggcgtaactgcgccgtagacgggcacgaggagggcttcttcttcggccctacgcttatcgacgacatcccactcacgttccgcgcctacaccgaagaaatcttcggcccggtcctctctgtcgttcgtgtcgcatccttcgacgaggcaattgagctgatcaactccggtgaattcggcaacggaaccgcaatcttcaccaacgatggtggagcggcacgccgcttccagcatgagatcgaagtgggcatgatcggcatcaacgtaccaatcccagtgcctgttgcgtaccactccttcggtggttggaagaactccctcttcggtgacgccaaggcatatggcactcaaggttttgatttcttcaccagggaaaaggcgatcaccagccgttggctcgacccagcaacccacggtggcattaacctcggtttcccacagaacgattaattgaaggagagcacaggact

SEQ ID NO: 136 - protein, 504 aa, Corynebacterium glutamicum
MSEPQTISHWIDGAISPSTSGKTAPVYNPATGQVTANVALASQEEIDATIASATKAAKTWGNLSIAKRQAVLFNFRELLNARKGELAEIITAEHGKVLSDAMGEILRGQEVVELATGFPHLLKGAFNENVSTGIDVYSLKQPLGVVGIISPFNFPAMVPMWFFPIAIAAGNAVILKPSEKDPSAALWMAQIWKEAGLPDGVFNVLQGDKLAVDGLLNSPDVSAISFVGSTPIAKYIYETSAKNGKRVQALGGAKNHMLVLPDADLDLVADQAINAGYGAAGERCMAVSVVLAIESVADELIEKIKERIDTLRIGNGAGDEQGEPHLGPLITDVHRDKVASYVDIAEADGAKIIVDGRNCAVDGHEEGFFFGPTLIDDIPLTFRAYTEEIFGPVLSVVRVASFDEAIELINSGEFGNGTAIFTNDGGAARRFQHEIEVGMIGINVPIPVPVAYHSFGGWKNSLFGDAKAYGTQGFDFFTREKAITSRWLDPATHGGINLGFPQND

SEQ ID NO: 137 - DNA, 531 bp, Corynebacterium glutamicum
  CDS (101)..(508): RXS02299
acgcgggggttgttgccggatcgaaatattcctttccttgtcatctcacgctatgatttctaaaacttgcaggacaacccccataaggacaccacaggacatgctgcgcaccatcctcggaagtaagattcaccgagccactgtcactcaagctgatctagattatgttggctctgtaaccatcgacgccgacctggttcacgccgccggattgatcgaaggcgaaaaagttgccatcgtagacatcaccaacggcgctcgtctggaaacttatgtcattgtgggcgacgccggaacgggcaatatttgcatcaatggtgccgctgcacaccttattaatcctggcgatcttgtgatcatcatgagctaccttcaggcaactgatgcggaagccaaggcgtatgagccaaagattgtgcacgtggacgccgacaaccgcatcgttgcgctcggcaacgatcttgcggaagcactacctggatccgggcttttgacgtcgagaagcatttagcgttttagctcgccaatatt

SEQ ID NO: 138 - protein, 136 aa, Corynebacterium glutamicum
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 139 - DNA, 1053 bp, Corynebacterium glutamicum
  CDS (101)..(1030): RXA01561
gtgcccagaaattctgcttgcactcacccaagccgtttagcaaattgaacctcacgttcataataatgttcattttcatcgagttctagaaaacacaggcatgctcaccctcaacgatgtcatcaccgcccaacaacgaaccgcccctcatgttcgacgaacgccacttttcgaagcagaccccatcgacggcacacaaatctggatcaaagcagagttcctccaaaagtgcggcgtgttcaaaacgcgtggagcattcaaccgccagctcgcagcttcggaaaacggactactcgacccaacggttggcatcgtcgcggcatcaggcggaaacgcaggactcgcaaatgcttttgccgcagcatccttaagcgttcccgccacggtattggtgcccgaaactgccccacaagtaaaagttgatcgcctcaagcaatacggtgcaaccgtgcaacaaatcggatctgaatatgcggaagcatttgaggcagctcaaacctttgagtcggaaactggtgctctgttttgccacgcctacgaccagcccgacatcgcagctggagcaggcgtcattgggctagaaattgtcgaagatcttcccgacgttgacaccatcgtggttgctgtcggtggcggtggactctatgcaggaatcgcagccgtcgtagcagcccacgacatcaaagtggtggccgttgaaccctccaaaattccaaccctgcacaactcactcattgccggccaaccagtcgatgtgaacgtttctggtatcgcggcagattctttgggggctcgccaaattggacgagaagcctttgacatcgcaactgcccatcccccaataggcgtcctagtggacgatgaagcaatcatcgcagctcgacgccacctctgggacaactaccgcatccctgccgagcatggcgctgccgcagcactcgcctctcttaccagtggagcatacaaacctgcagcagatgaaaaagtggcagtcattgtgtgcggagcgaacactgacctcacaacactgtgatgtgatttcaaacgatcaca

SEQ ID NO: 140 - protein, 310 aa, Corynebacterium glutamicum
MLTLNDVITAQQRTAPHVRRTPLFEADPIDGTQIWIKAEFLQKCGVFKTRGAFNRQLAASENGLLDPTVGIVAASGGNAGLANAFAAASLSVPATVLVPETAPQVKVDRLKQYGATVQQIGSEYAEAFEAAQTFESETGALFCHAYDQPDIAAGAGVIGLEIVEDLPDVDTIVVAVGGGGLYAGIAAVVAAHDIKVVAVEPSKIPTLHNSLIAGQPVDVNVSGIAADSLGARQIGREAFDIATAHPPIGVLVDDEAIIAARRHLWDNYRIPAEHGAAAALASLTSGAYKPAADEKVAVIVCGANTDLTTL

SEQ ID NO: 141 - DNA, 1470 bp, Corynebacterium glutamicum
  CDS (101)..(1447): RXA01850
ttcgtgcaacttcagactcttacggaggcgatggaccaaaaacaactacaatcaagcagatcaccttgtacaccaccagagaaaaggcccaccctcagccatggctatcagtgttgttgatctatttagcatcggtatcggaccatcatcctcacataccgtcggccccatgagagccgccctcacgtatatctctgaatttcccagctcgcatgtcgatatcacgttgcacggatcccttgccgccaccggtaaaggccactgcactgaccgggcggtattactgggtctggtgggatgggaaccaacgatagttcccattgatgctgcaccctcacccggcgcgccgattcctgcgaaaggttctgtgaacgggccaaagggaacggtgtcgtattccctgacgtttgatcctcatcctcttccagaacaccccaatgccgttacctttaaaggatcaaccacaaggacttatttgtcggtgggtggtgggttcattatgacgttggaggatttccggaagctggacgatatcggatcaggtgtgtcaaccattcatccagaggcagaggtgccttgtccttttcagaagagttcccaattactcgcatatggtcgcgattttgcggaggtcatgaaggataatgagcgcttaatccacggggatcttggcacagtggatgcccatttggatcgagtgtggcagattatgcaggagtgcgtggcacaaggcatcgcaacgccggggattttaccgggtgggttgaatgtgcaacgtcgggcgccgcaggtacacgcgctgattagcaacggggatacgtgtgagctgggtgctgatcttgatgctgtggagtgggtgaatctgtacgccttggcggtgaatgaagaaaacgccgctggtggtcgtgtggttactgctccgactaatggtgctgcggggattattccggcggtgatgcactatgcgcgggattttttgacaggttttggggcggagcaggcgcggacgtttttgtataccgcgggtgcggtgggcatcatcattaaggaaaatgcctcgatctctggcgcggaggtggggtgtcagggtgaggttggttcagcgtccgcgatggcggctgccgggttgtgtgcagtcttaggtggttctccgcaacaggtggaaaacgccgcggagattgcgttggagcacaatttgggattgacgtgcgatccggtgggcgggttagtgcagattccgtgtattgaacgcaacgctattgctgccatgaagtccatcaatgcggcaaggcttgcccggattggtgatggcaacaatcgcgtgagtttggatgatgtggtggtcacgatggctgccaccggccgggacatgctgaccaaatataaggaaacgtcccttggtggtttggcaaccaccttgggcttcccggtgtcgatgacggagtgttagcggtacggctttaacacggc

SEQ ID NO: 142 - protein, 449 aa, Corynebacterium glutamicum
MAISVVDLFSIGIGPSSSHTVGPMRAALTYISEFPSSHVDITLHGSLAATGKGHCTDRAVLLGLVGWEPTIVPIDAAPSPGAPIPAKGSVNGPKGTVSYSLTFDPHPLPEHPNAVTFKGSTTRTYLSVGGGFIMTLEDFRKLDDIGSGVSTIHPEAEVPCPFQKSSQLLAYGRDFAEVMKDNERLIHGDLGTVDAHLDRVWQIMQECVAQGIATPGILPGGLNVQRRAPQVHALISNGDTCELGADLDAVEWVNLYALAVNEENAAGGRVVTAPTNGAAGIIPAVMHYARDFLTGFGAEQARTFLYTAGAVGIIIKENASISGAEVGCQGEVGSASAMAAAGLCAVLGGSPQQVENAAEIALEHNLGLTCDPVGGLVQIPCIERNAIAAMKSINAARLARIGDGNNRVSLDDVVVTMAATGRDMLTKYKETSLGGLATTLGFPVSMTEC

SEQ ID NO: 143 - DNA, 1425 bp, Corynebacterium glutamicum
  CDS (101)..(1402): RXA00580
ttttatatatgggtatcggcggtctatgcttgtgggcgtacctgtcccgcgagtgaggtcttacgcgcgggattcgtcttgtgaaaggttagctgacctgatgaccgatgcccaccaagcggacgatgtccgttaccagccactgaacgagcttgatcctgaggtggctgctgccatcgctggggaacttgcccgtcaacgcgatacattagagatgatcgcgtctgagaacttcgttccccgttctgttttgcaggcgcagggttctgttcttaccaataagtatgccgagggttaccctggccgccgttactacggtggttgcgaacaagttgacatcattgaggatcttgcacgtgatcgtgcgaaggctctcttcggtgcagagttcgccaatgttcagcctcactctggcgcacaggctaatgctgctgtgctgatgactttggctgagccaggcgacaagatcatgggtctgtctttggctcatggtggtcacttgacccacggaatgaagttgaacttctccggaaagctgtacgaggttgttgcgtacggtgttgatcctgagaccatgcgtgttgatatggatcaggttcgtgagattgctctgaaggagcagccaaaggtaattatcgctggctggtctgcataccctcgccaccttgatttcgaggctttccagtctattgctgcggaagttggcgcgaagctgtgggtcgatatggctcacttcgctggtcttgttgctgctggtttgcacccaagcccagttccttactctgatgttgtttcttccactgtccacaagactttgggtggacctcgttccggcatcattctggctaagcaggagtacgcgaagaagctgaactcttccgtattcccaggtcagcagggtggtcctttgatgcacgcagttgctgcgaaggctacttctttgaagattgctggcactgagcagttccgtgaccgtcaggctcgcacgttggagggtgctcgcattcttgctgagcgtctgactgcttctgatgcgaaggccgctggcgtggatgtcttgaccggtggcactgatgtgcacttggttttggctgatctgcgtaactcccagatggatggccagcaggcggaagatctgctgcacgaggttggtatcactgtgaaccgtaacgcggttcctttcgatcctcgtccaccaatggttacttctggtctgcgtattggtactcctgcgctggctacccgtggtttcgatattcctgcattcactgaggttgcagacatcattggtactgctttggctaatggtaagtccgcagacattgagtctctgcgtggccgtgtagcaaagcttgctgcagattacccactgtatgagggcttggaagactggaccatcgtctaagtttttctttgagttttcat

SEQ ID NO: 144 - protein, 434 aa, Corynebacterium glutamicum
MTDAHQADDVRYQPLNELDPEVAAAIAGELARQRDTLEMIASENFVPRSVLQAQGSVLTNKYAEGYPGRRYYGGCEQVDIIEDLARDRAKALFGAEFANVQPHSGAQANAAVLMTLAEPGDKIMGLSLAHGGHLTHGMKLNFSGKLYEVVAYGVDPETMRVDMDQVREIALKEQPKVIIAGWSAYPRHLDFEAFQSIAAEVGAKLWVDMAHFAGLVAAGLHPSPVPYSDVVSSTVHKTLGGPRSGIILAKQEYAKKLNSSVFPGQQGGPLMHAVAAKATSLKIAGTEQFRDRQARTLEGARILAERLTASDAKAAGVDVLTGGTDVHLVLADLRNSQMDGQQAEDLLHEVGITVNRNAVPFDPRPPMVTSGLRIGTPALATRGFDIPAFTEVADIIGTALANGKSADIESLRGRVAKLAADYPLYEGLEDWTIV

SEQ ID NO: 145 - DNA, 401 bp, Corynebacterium glutamicum
  CDS (1)..(378): RXA01821
cgaaacagccaaggcaaatggtgcccaagtacgcgatcaccaaaaaataccagcatcgaagacaacggcgatcacgtagtcatccaagcaggcgaagaaaccacaatcgtggaccgcgttatcgtcaccaccggcagctggacaagcgagctcgtgccctccatcgcgccactgcttgaagtgcgacgcctagtgctcacctggttcctgcccaacaatccagtggacttccaaccggaaaacctgccatgcttcatccgtgaccgtgatggcttccacgtatttggagcaccatgcgtcgatgggtacagcatcaaaattgccggattggatgagtggggcgttccattaagcctcgatccaccgatgtgccctcggtgatgtcctgatcccggttccgg

SEQ ID NO: 146 - protein, 126 aa, Corynebacterium glutamicum
RNSQGKWCPSTRSPKNTSIEDNGDHVVIQAGEETTIVDRVIVTTGSWTSELVPSIAPLLEVRRLVLTWFLPNNPVDFQPENLPCFIRDRDGFHVFGAPCVDGYSIKIAGLDEWGVPLSLDPPMCPR

SEQ ID NO: 147 - DNA, 488 bp, Corynebacterium glutamicum
  CDS (101)..(478): RXN02263
cctgggcaacccaagtgtatgaaaacgccctggaaaaaggcgtcggcaccacattgaacctgtgggaatcacccgcactggcttgagagaagaaacaacaatgaaaattgcggtaatcggccttggatcaaccggctccatggcactgtggcacttaagtaacatcccaggtgtagaggccatcggctttgaacaattcggcatctcccatggctacggcgcattcacaggggagtcccgactgtttcgcatggcctaccacgaaggcagcacctacgttccgttgctcaaacgcgcacgagcactatggtcatcactgagcgagatttccggacgcgaactcttccacaacttcggtgtcttaagcaccggcaaggaagacgaagcacccttccaacgcctggtggaatcagtggaacgttatgagctgccacatgaacgacttaccgccgcgcagatgcgcagcgttacccaggtctagacttccg

SEQ ID NO: 148 - protein, 126 aa, Corynebacterium glutamicum
MKIAVIGLGSTGSMALWHLSNIPGVEAIGFEQFGISHGYGAFTGESRLFRMAYHEGSTYVPLLKRARALWSSLSEISGRELFHNFGVLSTGKEDEAPFQRLVESVERYELPHERLTAAQMRSVTQV

SEQ ID NO: 149 - DNA, 460 bp, Corynebacterium glutamicum
  CDS (101)..(460): FRXA02263
cctgggcaacccaagtgtatgaaaacgccctggaaaaaggcgtcggcaccacattgaacctgtgggaatcacccgcactggcttgagagaagaaacaacaatgaaaattgcggtaatcggccttggatcaaccggctccatggcactgtggcacttaagtaacatcccaggtgtagaggccatcggctttgaacaattcggcatctcccatggctacggcgcattcacaggggagtcccgactgtttcgcatggcctaccacgaaggcagcacctacgttccgttgctcaaacgcgcacgagcactatggtcatcactgagcgagatttccggacgcgaactcttccacaacttcggtgtcttaagcaccggcaaggaagacgaagcacccttccaacgcctggtggaatcagtggaacgttatgagctgccacatgaacgacttaccgccgcgcagatg

SEQ ID NO: 150 - protein, 120 aa, Corynebacterium glutamicum
MKIAVIGLGSTGSMALWHLSNIPGVEAIGFEQFGISHGYGAFTGESRLFRMAYHEGSTYVPLLKRARALWSSLSEISGRELFHNFGVLSTGKEDEAPFQRLVESVERYELPHERLTAAQM

SEQ ID NO: 151 - DNA, 1251 bp, Corynebacterium glutamicum
  CDS (101)..(1228): RXA02176
gggtgctaggaactgacagcttcagggttatagttgttgggtcagatcgttaacgatccctggcccttttacttccaagcgcagaaagttgcccgaagacatgaccgacttccccaccctgccctctgagttcatccctggcgacggccgtttcggctgcggaccttccaaggttcgaccagaacagattcaggctattgtcgacggatccgcatccgtcatcggtacctcacaccgtcagccggcagtaaaaaacgtcgtgggttcaatccgcgagggactctccgacctcttctcccttccagaaggctacgagatcatcctttccctaggtggtgcgaccgcattctgggatgcagcaaccttcggactcattgaaaagaagtccggtcacctttctttcggtgagttctcctccaagttcgcaaaggcttctaagcttgctccttggctcgacgagccagagatcgtcaccgcagaaaccggtgactctccggccccacaggcattcgaaggcgccgatgttattgcatgggcacacaacgaaacctccactggcgccatggttccagttcttcgccccgaaggctctgaaggctccctggttgccattgacgcaacctccggcgctggtggactgccagtagacatcaagaactccgatgtttactacttctccccacagaagtgcttcgcatccgacggtggcctgtggcttgcagcgatgagcccagcagctctcgagcgcatcgagaagatcaacgcttccgatcgcttcatccctgagttcctcaacctgcagaccgcagtggataactccctgaagaaccagacctacaacaccccagctgttgctaccttgctgatgctggacaaccaggtcaagtggatgaactccaacggcggcctggatggaatggttgctcgcaccacagcaagctcctccgccctgtacaactgggctgaggctcgcgaggaggcatccccatacgtggcagatgcagctaagcgctccctcgttgtcggcaccatcgacttcgatgactccatcgacgcagcagtgatcgctaagatactgcgcgcaaacggcatcctggacaccgagccttaccgcaagctgggacgcaaccagctgcgcatcggtatgttcccagcgatcgattccaccgatgtggaaaagctcaccggagcaatcgacttcatcctcgatggcggttttgcaaggaagtaatacccccactttgaaaaaca

SEQ ID NO: 152 - protein, 376 aa, Corynebacterium glutamicum
MTDFPTLPSEFIPGDGRFGCGPSKVRPEQIQAIVDGSASVIGTSHRQPAVKNVVGSIREGLSDLFSLPEGYEIILSLGGATAFWDAATFGLIEKKSGHLSFGEFSSKFAKASKLAPWLDEPEIVTAETGDSPAPQAFEGADVIAWAHNETSTGAMVPVLRPEGSEGSLVAIDATSGAGGLPVDIKNSDVYYFSPQKCFASDGGLWLAAMSPAALERIEKINASDRFIPEFLNLQTAVDNSLKNQTYNTPAVATLLMLDNQVKWMNSNGGLDGMVARTTASSSALYNWAEAREEASPYVADAAKRSLVVGTIDFDDSIDAAVIAKILRANGILDTEPYRKLGRNQLRIGMFPAIDSTDVEKLTGAIDFILDGGFARK

SEQ ID NO: 153 - DNA, 1422 bp, Corynebacterium glutamicum
  CDS (101)..(1399): RXN02758
atacatctcacccaattccccataactagacaattgcccagcaacgactgataagtctccaatgtcgtgttccgcgctcagacatgagacaattgttgccgtgactgaactcatccagaatgaatcccaagaaatcgctgagctggaagccggccagcaggttgcattgcgtgaaggttatcttcctgcggtgatcacagtgagcggtaaagaccgcccaggtgtgactgccgcgttctttagggtcttgtccgctaatcaggttcaggtcttggacgttgagcagtcaatgttccgtggctttttgaacttggcggcgtttgtgggtatcgcacctgagcgtgtcgagaccgtcaccacaggcctgactgacaccctcaaggtgcatggacagtccgtggtggtggagctgcaggaaactgtgcagtcgtcccgtcctcgttcttcccatgttgttgtggtgttgggtgatccggttgatgcgttggatatttcccgcattggtcagaccctggcggattacgatgccaacattgacaccattcgtggtatttcggattaccctgtgaccggcctggagctgaaggtgactgtgccggatgtcagccctggtggtggtgaagcgatgcgtaaggcgcttgctgctcttacctctgagctgaatgtggatattgcgattgagcgttctggtttgctgcgtcgttctaagcgtctggtgtgcttcgattgtgattccacgttgatcactggtgaggtcattgagatgctggcggctcacgcgggcaaggaagctgaagttgcggcagttactgagcgtgcgatgcgcggtgagctcgatttcgaggagtctctgcgtgagcgtgtgaaggcgttggctggtttggatgcgtcggtgatcgatgaggtcgctgccgctattgagctgacccctggtgcgcgcaccacgatccgtacgctgaaccgcatgggttaccagaccgctgttgtttccggtggtttcatccaggtgttggaaggtttggctgaggagttggagttggattatgtccgcgccaacactttggaaatcgttgatggcaagctgaccggcaacgtcaccggaaagatcgttgaccgcgctgcgaaggctgagttcctccgtgagttcgctgcggattctggcctgaagatgtaccagactgtcgctgtcggtgatggcgctaatgacatcgatatgctctccgctgcgggtctgggtgttgctttcaacgcgaagcctgcgctgaaggagattgcggatacttccgtgaaccacccattcctcgacgaggttttgcacatcatgggcatttcccgcgacgagatcgatctggcggatcaggaagacggcactttccaccgcgttccattgaccaatgcctaaagattcgtttctcgacgccc

SEQ ID NO: 154 - protein, 433 aa, Corynebacterium glutamicum
VTELIQNESQEIAELEAGQQVALREGYLPAVITVSGKDRPGVTAAFFRVLSANQVQVLDVEQSMFRGFLNLAAFVGIAPERVETVTTGLTDTLKVHGQSVVVELQETVQSSRPRSSHVVVVLGDPVDALDISRIGQTLADYDANIDTIRGISDYPVTGLELKVTVPDVSPGGGEAMRKALAALTSELNVDIAIERSGLLRRSKRLVCFDCDSTLITGEVIEMLAAHAGKEAEVAAVTERAMRGELDFEESLRERVKALAGLDASVIDEVAAAIELTPGARTTIRTLNRMGYQTAVVSGGFIQVLEGLAEELELDYVRANTLEIVDGKLTGNVTGKIVDRAAKAEFLREFAADSGLKMYQTVAVGDGANDIDMLSAAGLGVAFNAKPALKEIADTSVNHPFLDEVLHIMGISRDEIDLADQEDGTFHRVPLTNA

SEQ ID NO: 155 - DNA, 490 bp, Corynebacterium glutamicum
  CDS (101)..(490): FRXA02479
atacatctcacccaattccccataactagacaattgcccagcaacgactgataagtctccaatgtcgtgttccgcgctcagacatgagacaattgttgccgtgactgaactcatccagaatgaatcccaagaaatcgctgagctggaagccggccagcaggttgcattgcgtgaaggttatcttcctgcggtgatcacagtgagcggtaaagaccgcccaggtgtgactgccgcgttctttagggtcttgtccgctaatcaggttcaggtcttggacgttgagcagtcaatgttccgtggctttttgaacttggcggcgtttgtgggtatcgcacctgagcgtgtcgagaccgtcaccacaggcctgactgacaccctcaaggtgcatggacagtccgtggtggtggagctgcaggaaactgtgcagtcgtcccgtcctcgttcttcccatgttgttgtggtgttgggtgatccggttgatgcgctggat

SEQ ID NO: 156 - protein, 130 aa, Corynebacterium glutamicum
VTELIQNESQEIAELEAGQQVALREGYLPAVITVSGKDRPGVTAAFFRVLSANQVQVLDVEQSMFRGFLNLAAFVGIAPERVETVTTGLTDTLKVHGQSVVVELQETVQSSRPRSSHVVVVLGDPVDALD

SEQ ID NO: 157 - DNA, 558 bp, Corynebacterium glutamicum
  CDS (101)..(535): FRXA02758
aaggcgttggctggtttggatgcgtcggtgatcgatgaggtcgctgccgctattgagctgacccttggtgcgcgcaccacgatccgtacggttgaaccgcatgggttaccagaccgctgttgtttccggtggtttcatccaggtgttggaaggtttggctgaggagttggagttggattatgtccgcgccaacactttggaaatcgttgatggcaagctgaccggcaacgtcaccggaaagatcgttgaccgcgctgcgaaggctgagttcctccgtgagttcgctgcggattctggcctgaagatgtaccagactgtcgctgtcggtgatggcgctaatgacatcgatatgctctccgctgcgggtctgggtgttgctttcaacgcgaagcctgcgctgaaggagattgcggatacttccgtgaaccacccattcctcgacgaggttttgcacatcatgggcatttcccgcgacgagatcgatctggcggatcaggaagacggcactttccaccgcgttccattgaccaatgcctaaagattcgtttctcgacgccc

SEQ ID NO: 158 - protein, 145 aa, Corynebacterium glutamicum
MGYQTAVVSGGFIQVLEGLAEELELDYVRANTLEIVDGKLTGNVTGKIVDRAAKAEFLREFAADSGLKMYQTVAVGDGANDIDMLSAAGLGVAFNAKPALKEIADTSVNHPFLDEVLHIMGISRDEIDLADQEDGTFHRVPLTNA

SEQ ID NO: 159 - DNA, 205 bp, Corynebacterium glutamicum
  CDS (72)..(182): FRXA02759
tcttacttctaagctgaatgtgatattgcgattaagcgttctggtttgctgcgtcgttctaagcgtctggtgtgcttcgattgtatcccacgttgatcactggtgaggtcattgagatgctggcggctcacgcgggcaaggaagctaaagttgcggcagttactgagcgtgcgatgcgcgggtgagctcgatttcgaggagtctc

SEQ ID NO: 160 - protein, 37 aa, Corynebacterium glutamicum
VLRLYPTLITGEVIEMLAAHAGKEAKVAAVTERAMRG

SEQ ID NO: 161 - DNA, 1188 bp, Corynebacterium glutamicum
  CDS (101)..(1165): RXA02501
cgccccgaaagctttaccatggatacgatactcaatggagatatccattatcggtttggcgtctgtgcgctcatgaaccaggaaggtttttgtttgtctcatgagctctgaaggaagaaaccacaactgggactacgccgccatcggcaccccagaggatttcctcgccagctggagcgcatcccgcggaaatctacgacgctttttcgaagaccacgcagccgcccccataaacgatgccgcccagcgccaagcaggtgaagccgcagcaacccaagccgtcgcagcgatctacggcatggagctcaacgaattcaacgcaggtgtcgacgccgtcgccggcgccatcgaatctgccggcgccatccacgtcagcatccccgatcccgatgtcccccaagatgtcggagccgcagcatttttcgacgtcgacaacaccctcatccaaggctcctccctcatcgttttcgcccaaggactcttccggaagaaattcttcaccatcaaagaaatcctccccgtggtgtggaaacaagtgaaattcaaactcaccggctccgaaaacgccgacgacgtctcccgcggccgcgaacaagccctcgaattcatcaaaggccgccccgtccaagaactagttgacctctgcgaagaaatcgtcgaccaacgcatggccgacaaaatgtggcccggcaccaaacaactcgccgacatgcacatcgccgccggccaccaagtctggctcgtctccgcaacccccgtccaactcgcccaaatcctggcacaacgcctcggcttcaccggagcgatcggcacagtcgcagaagcaaaagatggagtattcaccggccgactcgtcggcgacatcctccacggacccggcaaaagacacgcagtcgcagcactcgcatccatcgaacaactcgacctcacccgatgcaccgcctactccgactccatcaacgacctccccatgctctccatggtcggcaccgccgtcgcagtaaaccccgactccaaactccgcaaagaagccgaaacccgaggctgggacgtccgcgatttccgaagcatccgcaaagccacccgcgaatacggaatccccgccctggtcaccgccgcattcagtgtcgccggctggagtctacgccgccgatggagaaaacaataacgcacaggagccgttttaag

SEQ ID NO: 162 - protein, 355 aa, Corynebacterium glutamicum
MSSEGRNHNWDYAAIGTPEDFLASWSASRGNLRRFFEDHAAAPINDAAQRQAGEAAATQAVAAIYGMELNEFNAGVDAVAGAIESAGAIHVSIPDPDVPQDVGAAAFFDVDNTLIQGSSLIVFAQGLFRKKFFTIKEILPVVWKQVKFKLTGSENADDVSRGREQALEFIKGRPVQELVDLCEEIVDQRMADKMWPGTKQLADMHIAAGHQVWLVSATPVQLAQILAQRLGFTGAIGTVAEAKDGVFTGRLVGDILHGPGKRHAVAALASIEQLDLTRCTAYSDSINDLPMLSMVGTAVAVNPDSKLRKEAETRGWDVRDFRSIRKATREYGIPALVTAAFSVAGWSLRRRWRKQ

SEQ ID NO: 163 - DNA, 558 bp, Corynebacterium glutamicum
  CDS (101)..(535): RXN03105
ggttggggtcatcaaaggatgcggacatcgctgtggggttgtgtaataattgcacctgtgaggtgcctttctggcaggtgaatcaggactctaagcaagcttgattcttccagttcaggagggcatttcctattttcccacgccgttacacctgaatcacatcggtggatccaggttaagcgcacatgtagaagatgaagatctccgcctcgaccgggacgcagtctctgaatttggtcggaaaacccacgaactcttccccggggtcaacccagagcccaaccgtttcagcgtccactatgacacctacactgcagacaaatctccaattatcgacgcggttgacaatgtcattgtgctcaccggaggatccggacacgccttcaagctctctccagcttatggcgaactcgcagcacaacgagcggtcggaaacacctcgccgctgtacagcgaagactttcggatcgcctcgcatgaaccaatcaaagagcggtgcacgtatagaaagctaacctttttaagtgcgcggttttagggtgagaatctaacgctgag

SEQ ID NO: 164 - protein, 145 aa, Corynebacterium glutamicum
LILPVQEGISYFPTPLHLNHIGGSRLSAHVEDEDLRLDRDAVSEFGRKTHELFPGVNPEPNRFSVHYDTYTADKSPIIDAVDNVIVLTGGSGHAFKLSPAYGELAAQRAVGNTSPLYSEDFRIASHEPIKERCTYRKLTFLSARF

SEQ ID NO: 165 - DNA, 687 bp, Corynebacterium glutamicum
  CDS (62)..(664): RXS01130
agttcgtggcggatgctgtgaacgtttccggtggtcgcgtgggcgaagaggttctgtgtggatggatctggctcgcaagcttggtcttcttgctggcaagcttgtcgacgccgccccagtctccattgaggttgaggctcgaggcgagctttcttccgagcaggtcaatgcacttggtttgtccgctgttcgtggtttgttctccggaattatcgaagagtccgttactttcgtcaacgctcctcgcattgctgaagagcgtggcctggacatctccgtgaagaccaactctgagtctgttactcaccgttccgtcctgcaggtcaaggtcattactggcagcggcgcgagcgcaactgttgttggtgccctgactggtcttgagcgcgttgagaagatcacccgcatcaatggccgtggcctggatctgcgcgcagagggtctgaacctcttcctgcagtacactgacgctcctggtgcactgggtaccgttggtaccaagctgggtgctgctggcatcaacatcgaggctgctgcgttgactcaggctgagaagggtgacggcgctgtcctgatcctgcgtgttgagtccgctgtctctgaagagctggaagctgaaatcaacgctgagttgggtgctacttccttccaggttgatcttgactaattagagatccatttgcttga

SEQ ID NO: 166 - protein, 201 aa, Corynebacterium glutamicum
MDLARKLGLLAGKLVDAAPVSIEVEARGELSSEQVNALGLSAVRGLFSGIIEESVTFVNAPRIAEERGLDISVKTNSESVTHRSVLQVKVITGSGASATVVGALTGLERVEKITRINGRGLDLRAEGLNLFLQYTDAPGALGTVGTKLGAAGINIEAAALTQAEKGDGAVLILRVESAVSEELEAEINAELGATSFQVDLD

SEQ ID NO: 167 - DNA, 604 bp, Corynebacterium glutamicum
  CDS (101)..(604): RXS03112
gtgagcacgcaatttctttgctgctgtctactgctcgccagatcctgctgctgatgcgacgctgcgtgagggcgagtggaagcggtcttctttcaacggtgtggaaattttcggaaaaactgtcggtatcgtcggttttggccacattggtcagttgtttgctcagcgtcttgctgcgtttgagaccaccattgttgcttacgatccttacgctaaccctgctcgtgcggctcagctgaacgttgagttggttgagttggatgagctgatgagccgttctgactttgtcaccattcaccttcctaagaccaaggaaactgctggcatgtttgatgcgcacctccttgctaagtccaagaagggccagatcatcatcaacgctgctcgtggtggccttgttgatgagcaggctttggctgatgcgattgagtccggtcacattcgtggcgctggtttcgatgtgtactccaccgagccttgcactgattctcctttgttcaagttgcctcaggttgttgtgactcctcacttgggtgcttctactgaagaggctcaagatcgtgcgggtactgacattgctgattctgtgctcaaggcgctggct

SEQ ID NO: 168 - protein, 168 aa, Corynebacterium glutamicum
VEIFGKTVGIVGFGHIGQLFAQRLAAFETTIVAYDPYANPARAAQLNVELVELDELMSRSDFVTIHLPKTKETAGMFDAHLLAKSKKGQIIINAARGGLVDEQALADAIESGHIRGAGFDVYSTEPCTDSPLFKLPQVVVTPHLGASTEEAQDRAGTDIADSVLKALA

SEQ ID NO: 169 - DNA, 1458 bp, Corynebacterium glutamicum
  CDS (101)..(1435): RXN00969
ctatagtggctaggtaccctttttgttttggacacatgtagggtggccgaaacaaagtaataggacaacaacgctcgaccgcgattatttttggagaatcatgacctcagcatctgccccaagctttaaccccggcaagggtcccggctcagcagtcggaattgcccttttaggattcggaacagtcggcactgaggtgatgcgtctgatgaccgagtacggtgatgaacttgcgcaccgcattggtggcccactggaggttcgtggcattgctgtttctgatatctcaaagccacgtgaaggcgttgcacctgagctgctcactgaggacgcttttgcactcatcgagcgcgaggatgttgacatcgtcgttgaggttatcggcggcattgagtacccacgtgaggtagttctcgcagctctgaaggccggcaagtctgttgttaccgccaataaggctcttgttgcagctcactctgctgagcttgctgatgcagcggaagccgcaaacgttgacctgtacttcgaggctgctgttgcatgcgcaattccagtggttggcccactgcgtcgctccctggctggcgatcagatccagtctgtgatgggcatcgttaacggcaccaccaacttcatcttggacgccatggattccaccggcgctgactatgcagattctttggctgaggcaactcgtttgggttacgccgaagctgatccaactgcaaacgtcgaaggccatgacgccgcatccaaggctgcaattttggcatgcatcgctttccacacccgtgttaccgcggatgatgtgtactgcgaaggtattaggaacatcaacgctgccgacattgaggcagcacagcaggcaggccacaccatcaagttgttggccatctgtgagaagttcaccaacaaggaaggaaagtcggctatttctgctcgcgtgcacccgactctattacctgtgtcccacccactggcgtcggtaaacaagtcctttaatgcaatctttgttgaagcagaagcagctggtcgcctgatgttctacggaaacggtgcaggtggcgcgccaaccgcgtctgctgtgcttggcgacgtcgttggtgccgcacgaaacaaggtgcacggtggccgtgctccaggtgagtccacctacgctaacctgccgatcgctgatttcggtgagaccaccactcgttaccacctcgacatggatgtggaagatcgcgtgggggttttggctgaattggctagcctgttctctgagcaaggaatctccctgcgtacaatccgacaggaagagcgcgatgatgatgcacgtctgatcgtggtcacccactctgcgctggaatctgatctttcccgcaccgttgaactgctgaaggctaagcctgttgttaaggcaatcaacagtgtgatccgcctcgaaagggactaattttactgacatggcaattg

SEQ ID NO: 170 - protein, 445 aa, Corynebacterium glutamicum
MTSASAPSFNPGKGPGSAVGIALLGFGTVGTEVMRLMTEYGDELAHRIGGPLEVRGIAVSDISKPREGVAPELLTEDAFALIEREDVDIVVEVIGGIEYPREVVLAALKAGKSVVTANKALVAAHSAELADAAEAANVDLYFEAAVACAIPVVGPLRRSLAGDQIQSVMGIVNGTTNFILDAMDSTGADYADSLAEATRLGYAEADPTANVEGHDAASKAAILACIAFHTRVTADDVYCEGIRNINAADIEAAQQAGHTIKLLAICEKFTNKEGKSAISARVHPTLLPVSHPLASVNKSFNAIFVEAEAAGRLMFYGNGAGGAPTASAVLGDVVGAARNKVHGGRAPGESTYANLPIADFGETTTRYHLDMDVEDRVGVLAELASLFSEQGISLRTIRQEERDDDARLIVVTHSALESDLSRTVELLKAKPVVKAINSVIRLERD

SEQ ID NO: 171 - DNA, 493 bp, Corynebacterium glutamicum
  CDS (101)..(493): FRXA00974
ctatagtggctaggtaccctttttgttttggacacatgtagggtggccgaaacaaagtaataggacaacaacgctcgaccgcgattatttttggagaatcatgacctcagcatctgccccaagctttaaccccggcaagggtcccggctcagcagtcggaattgcccttttaggattcggaacagtcggcactgaggtgatgcgtctgatgaccgagtacggtgatgaacttgcgcaccgcattggtggcccactggaggttcgtggcattgctgtttctgatatctcaaagccacgtgaaggcgttgcacctgagctgctcactgaggacgcttttgcactcatcgagcgcgaggatgttgacatcgtcgttgaggttatcggcggcattgagtacccacgtgaggtagttctcgcagctctgaaggccggcaagtctgttgttaccgccaataaggctcttgttgcagctcactctgctgagcttgctgat

SEQ ID NO: 172 - protein, 131 aa, Corynebacterium glutamicum
MTSASAPSFNPGKGPGSAVGIALLGFGTVGTEVMRLMTEYGDELAHRIGGPLEVRGIAVSDISKPREGVAPELLTEDAFALIEREDVDIVVEVIGGIEYPREVVLAALKAGKSVVTANKALVAAHSAELAD

SEQ ID NO: 173 - DNA, 1050 bp, Corynebacterium glutamicum
  CDS (101)..(1027): RXA00970
gaatctgatctttcccgcaccgttgaactgctgaaggctaagcctgttgttaaggcaatcaacagtgtgatccgcctcgaaagggactaattttactgacatggcaattgaactgaacgtcggtcgtaaggttaccgtcacggtacctggatcttctgcaaacctcggacctggctttgacactttaggtttggcactgtcggtatacgacactgtcgaagtggaaattattccatctggcttggaagtggaagtttttggcgaaggccaaggcgaagtccctcttgatggctcccacctggtggttaaagctattcgtgctggcctgaaggcagctgacgctgaagttcctggattgcgagtggtgtgccacaacaacattccgcagtctcgtggtcttggctcctctgctgcagcggcggttgctggtgttgctgcagctaatggtttggcggatttcccgctgactcaagagcagattgttcagttgtcctctgcctttgaaggccacccagataatgctgcggcttctgtgctgggtggagcagtggtgtcgtggacaaatctgtctatcgacggcaagagccagccacagtatgctgctgtaccacttgaggtgcaggacaatattcgtgcgactgcgctggttcctaatttccacgcatccaccgaagctgtgcgccgagtccttcccactgaagtcactcacatcgatgcgcgatttaacgtgtcccgcgttgcagtgatgatcgttgcgttgcagcagcgtcctgatttgctgtgggagggtactcgtgaccgtctgcaccagccttatcgtgcagaagtgttgcctattacctctgagtgggtaaaccgcctgcgcaaccgtggctacgcggcatacctttccggtgccggcccaaccgccatggtgctgtccactgagccaattccagacaaggttttggaagatgctcgtgagtctggcattaaggtgcttgagcttgaggttgcgggaccagtcaaggttgaagttaaccaaccttaggcccaacaaggaaggccccc

SEQ ID NO: 174 - protein, 309 aa, Corynebacterium glutamicum
MAIELNVGRKVTVTVPGSSANLGPGFDTLGLALSVYDTVEVEIIPSGLEVEVFGEGQGEVPLDGSHLVVKAIRAGLKAADAEVPGLRVVCHNNIPQSRGLGSSAAAAVAGVAAANGLADFPLTQEQIVQLSSAFEGHPDNAAASVLGGAVVSWTNLSIDGKSQPQYAAVPLEVQDNIRATALVPNFHASTEAVRRVLPTEVTHIDARFNVSRVAVMIVALQQRPDLLWEGTRDRLHQPYRAEVLPITSEWVNRLRNRGYAAYLSGAGPTAMVLSTEPIPDKVLEDARESGIKVLELEVAGPVKVEVNQP

SEQ ID NO: 175 - DNA, 1566 bp, Corynebacterium glutamicum
  CDS (101)..(1543): RXA00330
gcaacactttagggtatcgcgtgggcgaagtcacctttttcaacatatttgagacggtgtgggggagtattgtgtcaccccttgggatagggttatatccgtggactacatttcgacgcgtgatgccagccgtacccctgcccgcttcagtgatattttgctgggcggtctagcaccagacggcggactgtacctgcctgcaacctaccctcaactagatgatgcccagctgagtaaatggcgtgaggtattagccaacgaaggatacgcagctttggctgctgaagttatctccctgtttgttgatgacatcccagtagaagacatcaaggcgatcaccgcacgcgcctacacctacccgaagttcaacagcgaagacatcgttcctgtcaccgaactcgaggacaacatttacctgggccacctttccgaaggcccaaccgctgcattcaaagacatggccatgcagctgctcggcgaacttttcgaatacgagcttcgccgccgcaacgaaaccatcaacatcctgggcgctacctctggcgataccggctcctctgcggaatacgccatgcgcggccgcgagggaatccgcgtattcatgctgaccccagctggccgcatgaccccattccagcaagcacagatgtttggccttgacgatccaaacatcttcaacatcgccctcgacggcgttttcgacgattgccaagacgtagtcaaggctgtctccgccgacgcagaattcaaaaaagacaaccgcatcggtgccgtgaactccatcaactgggcacgccttatggcacaggttgtgtactacgtttcctcatggatccgcaccacaaccagcaatgaccaaaaggtcagcttctccgtaccaaccggcaacttcggtgacatttgcgcaggccacatcgcccgccaaatgggacttcccatcgatcgcctcatcgtggccaccaacgaaaacgatgtgctcgacgagttcttccgtaccggcgactaccgagtccgcagctccgcagacacccacgagacctcctcaccttcgatggatatctcccgcgcctccaacttcgagcgtttcatcttcgacctgctcggccgcgacgccacccgcgtcaacgatctatttggtacccaggttcgccaaggcggattctcactggctgatgacgccaactttgagaaggctgcagcagaatacggtttcgcctccggacgatccacccatgctgaccgtgtggcaaccatcgctgacgtgcattcccgcctcgacgtactaatcgatccccacaccgccgacggcgttcacgtggcacgccagtggagggacgaggtcaacaccccaatcatcgtcctagaaactgcactcccagtgaaatttgccgacaccatcgtcgaagcaattggtgaagcacctcaaactccagagcgtttcgccgcgatcatggatgctccattcaaggtttccgacctaccaaacgacaccgatgcagttaagcagtacatagtcgatgcgattgcaaacacttccgtgaagtaacttgctttacgccaaggcct

SEQ ID NO: 176 - protein, 481 aa, Corynebacterium glutamicum
VDYISTRDASRTPARFSDILLGGLAPDGGLYLPATYPQLDDAQLSKWREVLANEGYAALAAEVISLFVDDIPVEDIKAITARAYTYPKFNSEDIVPVTELEDNIYLGHLSEGPTAAFKDMAMQLLGELFEYELRRRNETINILGATSGDTGSSAEYAMRGREGIRVFMLTPAGRMTPFQQAQMFGLDDPNIFNIALDGVFDDCQDVVKAVSADAEFKKDNRIGAVNSINWARLMAQVVYYVSSWIRTTTSNDQKVSFSVPTGNFGDICAGHIARQMGLPIDRLIVATNENDVLDEFFRTGDYRVRSSADTHETSSPSMDISRASNFERFIFDLLGRDATRVNDLFGTQVRQGGFSLADDANFEKAAAEYGFASGRSTHADRVATIADVHSRLDVLIDPHTADGVHVARQWRDEVNTPIIVLETALPVKFADTIVEAIGEAPQTPERFAAIMDAPFKVSDLPNDTDAVKQYIVDAIANTSVK

SEQ ID NO: 177 - DNA, 1254 bp, Corynebacterium glutamicum
  CDS (101)..(1231): RXN00403
tttttcagactcgtgagaatgcaaactagactagacagagctgtccatatacactggacgaagttttagtcttgtccacccagaacaggcggttattttcatgcccaccctcgcgccttcaggtcaacttgaaatccaagcgatcggtgatgtctccaccgaagccggagcaatcattacaaacgctgaaatcgcctatcaccgctggggtgaataccgcgtagataaagaaggacgcagcaatgtcgttctcatcgaacacgccctcactggagattccaacgcagccgattggtgggctgacttgctcggtcccggcaaagccatcaacactgatatttactgcgtgatctgtaccaacgtcatcggtggttgcaacggttccaccggacctggctccatgcatccagatggaaatttctggggtaatcgcttccccgccacgtccattcgtgatcaggtaaacgccgaaaaacaattcctcgacgcactcggcatcaccacggtcgccgcagtacttggtggttccatgggtggtgcccgcaccctagagtgggccgcaatgtacccagaaactgttggcgcagctgctgttcttgcagtttctgcacgcgccagcgcctggcaaatcggcattcaatccgcccaaattaaggcgattgaaaacgaccaccactggcacgaaggcaactactacgaatccggctgcaacccagccaccggactcggcgccgcccgacgcatcgcccacctcacctaccgtggcgaactagaaatcgacgaacgcttcggcaccaaagcccaaaagaacgaaaacccactcggtccctaccgcaagcccgaccagcgcttcgccgtggaatcctacttggactaccaagcagacaagctagtacagcgtttcgacgccggctcctacgtcttgctcaccgacgccctcaaccgccacgacattggtcgcgaccgcggaggcctcaacaaggcactcgaatccatcaaagttccagtccttgtcgcaggcgtagataccgatattttgtacccctaccaccagcaagaacacctctccagaaacctgggaaatctactggcaatggcaaaaatcgtatcccctgtcggccacgatgctttcctcaccgaaagccgccaaatggatcgcatcgtgaggaacttcttcagcctcatctccccagacgaagacaacccttcgacctacatcgagttctacatctaataggtatttacgacaaatag

SEQ ID NO: 178 - protein, 377 aa, Corynebacterium glutamicum
MPTLAPSGQLEIQAIGDVSTEAGAIITNAEIAYHRWGEYRVDKEGRSNVVLIEHALTGDSNAADWWADLLGPGKAINTDIYCVICTNVIGGCNGSTGPGSMHPDGNFWGNRFPATSIRDQVNAEKQFLDALGITTVAAVLGGSMGGARTLEWAAMYPETVGAAAVLAVSARASAWQIGIQSAQIKAIENDHHWHEGNYYESGCNPATGLGAARRIAHLTYRGELEIDERFGTKAQKNENPLGPYRKPDQRFAVESYLDYQADKLVQRFDAGSYVLLTDALNRHDIGRDRGGLNKALESIKVPVLVAGVDTDILYPYHQQEHLSRNLGNLLAMAKIVSPVGHDAFLTESRQMDRIVRNFFSLISPDEDNPSTYIEFYI

SEQ ID NO: 179 - DNA, 1210 bp, Corynebacterium glutamicum
  CDS (101)..(1210): FRXA00403
tttttcagactcgtgagaatgcaaactagactagacagagctgtccatatacactggacgaagttttagtcttgtccacccagaacaggcggttattttcatgcccaccctcgcgccttcaggtcaacttgaaatccaagcgatcggtgatgtctccaccgaagccggagcaatcattacaaacgctgaaatcgcctatcaccgctggggtgaataccgcgtagataaagaaggacgcagcaatgtcgttctcatcgaacacgccctcactggagattccaacgcagccgattggtgggctgacttgctcggtcccggcaaagccatcaacactgatatttactgcgtgatctgtaccaacgtcatcggtggttgcaacggttccaccggacctggctccatgcatccagatggaaatttctggggtaatcgcttccccgccacgtccattcgtgatcaggtaaacgccgaaaaacaattcctcgacgcactcggcatcaccacggtcgccgcagtacttggtggttccatgggtggtgcccgcaccctagagtgggccgcaatgtacccagaaactgttggcgcagctgctgttcttgcagtttctgcacgcgccagcgcctggcaaatcggcattcaatccgcccaaattaaggcgattgaaaacgaccaccactggcacgaaggcaactactacgaatccggctgcaacccagccaccggactcggcgccgcccgacgcatcgcccacctcacctaccgtggcgaactagaaatcgacgaacgcttcggcaccaaagcccaaaagaacgaaaacccactcggtccctaccgcaagcccgaccagcgcttcgccgtggaatcctacttggactaccaagcagacaagctagtacagcgtttcgacgccggctcctacgtcttgctcaccgacgccctcaaccgccacgacattggtcgcgaccgcggaggcctcaacaaggcactcgaatccatcaaagttccagtccttgtcgcaggcgtagataccgatattttgtacccctaccaccagcaagaacacctctccagaaacctgggaaatctactggcaatggcaaaaatcgtatcccctgtcggccacgatgctttcctcaccgaaagccgccaaatggatcgcatcgtgaggaacttcttcagcctcatctccccagacgaagacaacccttcg

SEQ ID NO: 180 - protein, 370 aa, Corynebacterium glutamicum
MPTLAPSGQLEIQAIGDVSTEAGAIITNAEIAYHRWGEYRVDKEGRSNVVLIEHALTGDSNAADWWADLLGPGKAINTDIYCVICTNVIGGCNGSTGPGSMHPDGNFWGNRFPATSIRDQVNAEKQFLDALGITTVAAVLGGSMGGARTLEWAAMYPETVGAAAVLAVSARASAWQIGIQSAQIKAIENDHHWHEGNYYESGCNPATGLGAARRIAHLTYRGELEIDERFGTKAQKNENPLGPYRKPDQRFAVESYLDYQADKLVQRFDAGSYVLLTDALNRHDIGRDRGGLNKALESIKVPVLVAGVDTDILYPYHQQEHLSRNLGNLLAMAKIVSPVGHDAFLTESRQMDRIVRNFFSLISPDEDNPS

SEQ ID NO: 181 - DNA, 771 bp, Corynebacterium glutamicum; identical to SEQ ID NO: 11
  CDS (101)..(748): RXC01207

SEQ ID NO: 182 - protein, 216 aa, Corynebacterium glutamicum; identical to SEQ ID NO: 12

SEQ ID NO: 183 - DNA, 1419 bp, Corynebacterium glutamicum
  CDS (101)..(1396): RXC00152
gtcattgatatccaaggcacgaccgcgattgtatggaaagaagcctaaatttttaacaatcaaatagtactggccattcccaactaaaactggagtaacgatgacaggactaatcctcgccatagttttcctggtctttgtcgccgtcgtggtgatcaagtccatagccctgattccccagggtgaagccgccgtcattgaacgccttggtagctacacccgcaccgtttcaggtggcctgaccctgctggttccattcgtggaccgagtacgcgcaaggatcgacacccgtgagcgcgtggtctcattcccaccgcaggctgttattacccaagacaacctgaccgtggccatcgatatcgtggtgaccttccaaatcaacgaaccagagcgcgccatctacggcgtggacaactacatcgtcggtgtggagcagatttctgtagcaacacttcgagacgttgtcggtggcatgaccctggaagaaaccctcacttcacgtgacgtgatcaaccgccgcctccgtggcgagctcgatgcagcaaccaccaaatggggcctgcgcatcagccgtgtggaactaaaggcaattgatccgccaccatccatccagcaatcgatggaaaagcagatgaaggcagaccgtgaaaagcgcgccaccattttgaccgcagaaggtcagcgcgaagccgacatcaaaactgccgaaggtgaaaagcaagccaagatcctccaagctgagggtgaaaagcacgcatccatcctgaacgcagaagcagaacgccaagcgatgatcctgcgcgccgaaggtgaacgcgcagcacgctacctccaggcgcagggtgaagcccgagcaatccaaaaggtcaacgcagcaatcaagtctgccaagttgaccccagaggttcttgcttatcaatacctcgaaaagcttcctaagatcgcagagggcaacgcctccaagatgtgggtcatcccaagccagttctccgattctctggaaggttttgcgaagcagttcggcgcaaaggatgcagaaggtgtcttccgctacgaaccaaacaccgtggatgaagaaacccgcgacatcgcaaacgccgacaacgtggaagactggttctccaccgaatcagaccctgaaatcgcagcagcagtcgccgcagcaaacgccgtggccaacaagccagtcgatccagaacccggtgagatcctttccaagaagaccgcacgacgcgttgaacctgaagcagtattggaggctttgcaaaacggaaccactacacaacctgaggttgaggcagcacctcctaccgcaaacttcgcccaagaattccctgcaccacaggcaaaccctgaagattactccgaccaacaccgagagaatccttacggaaactaatcaggcataagaaaaggcgg

SEQ ID NO: 184 - protein, 432 aa, Corynebacterium glutamicum
MTGLILAIVFLVFVAVVVIKSIALIPQGEAAVIERLGSYTRTVSGGLTLLVPFVDRVRARIDTRERVVSFPPQAVITQDNLTVAIDIVVTFQINEPERAIYGVDNYIVGVEQISVATLRDVVGGMTLEETLTSRDVINRRLRGELDAATTKWGLRISRVELKAIDPPPSIQQSMEKQMKADREKRATILTAEGQREADIKTAEGEKQAKILQAEGEKHASILNAEAERQAMILRAEGERAARYLQAQGEARAIQKVNAAIKSAKLTPEVLAYQYLEKLPKIAEGNASKMWVIPSQFSDSLEGFAKQFGAKDAEGVFRYEPNTVDEETRDIANADNVEDWFSTESDPEIAAAVAAANAVANKPVDPEPGEILSKKTARRVEPEAVLEALQNGTTTQPEVEAAPPTANFAQEFPAPQANPEDYSDQHRENPYGN

SEQ ID NO: 185 - DNA, 1170 bp, Corynebacterium glutamicum
  CDS (101)..(1147): RXA00115
tggattctcgagtctgtacacccttgatcaaagcccgagtgttccgtagattaactttgtcgtatattgtgacctacaccccatactgttaggagttttcatgctcgacaatagtttttacaccgcagaggttcagggcccatacgaaaccgcttccattggccggctcgaactcgaagaagggggtgtgattgaggattgctggttggcttacgctacagctggaacgctcaacgaggacaagtccaacgccatcctcattccgacgtggtactccggaacccatcagacctggttccagcagtacatcggcactgatcatgcgctggatccatcaaagtatttcatcatctccatcaaccaaatcggtaatggtttgtcggtctcccctgccaacacggctgatgacagcatctcgatgtccaagttcccgaatgttcgcattggtgatgatgtcgttgcccaggaccggctcttgcgccaagagtttggtattaccgagctctttgccgtcgttggtggttcgatgggtgcgcagcaaacctatgagtggattgttcgcttccctgaccaagttcatcgagcagctccgatcgcgggcactgcgaagaacactcctcatgatttcatcttcacccagactcttaatgagaccgttgaggccgatccagggttcaatggcggcgaatactcctcccatgaagaggtagctgatggacttcgccgtcaatcgcatctttgggctgccatgggattttccacagagttctggaagcaggaggcatggcgtcgcctgggacttgaaagtaaggagtcagtgctcgcggacttcctggatccgctgttcatgtccatggatcctaataccttgctcaacaacgcttggaagtggcagcatggcgatgtctctcgccacaccggcggcgacttggcagcggctcttggccgagtgaaggctaagaccttcgttatgcccatcagcgaggacatgttctttcctgttcgtgactgtgccgcagaacaagcactcatcccaggcagcgagcttcgagtgatcgaagacatcgccggtcaccttgggctttttaacgtctctgagaattacatcccacagatcgacaaaaatctgaaagagctgttcgagagctaaacactgatgtcaaagagcct

SEQ ID NO: 186 - protein, 349 aa, Corynebacterium glutamicum
MLDNSFYTAEVQGPYETASIGRLELEEGGVIEDCWLAYATAGTLNEDKSNAILIPTWYSGTHQTWFQQYIGTDHALDPSKYFIISINQIGNGLSVSPANTADDSISMSKFPNVRIGDDVVAQDRLLRQEFGITELFAVVGGSMGAQQTYEWIVRFPDQVHRAAPIAGTAKNTPHDFIFTQTLNETVEADPGFNGGEYSSHEEVADGLRRQSHLWAAMGFSTEFWKQEAWRRLGLESKESVLADFLDPLFMSMDPNTLLNNAWKWQHGDVSRHTGGDLAAALGRVKAKTFVMPISEDMFFPVRDCAAEQALIPGSELRVIEDIAGHLGLFNVSENYIPQIDKNLKELFES

SEQ ID NO: 187 - DNA, 1254 bp, Corynebacterium glutamicum; identical to SEQ ID NO: 177
  CDS (101)..(1231): RXN00403

SEQ ID NO: 188 - protein, 377 aa, Corynebacterium glutamicum; identical to SEQ ID NO: 178

SEQ ID NO: 189 - DNA, 1210 bp, Corynebacterium glutamicum; identical to SEQ ID NO: 179
  CDS (101)..(1210): FRXA00403

SEQ ID NO: 190 - protein, 370 aa, Corynebacterium glutamicum; identical to SEQ ID NO: 180

SEQ ID NO: 191 - DNA, 687 bp, Corynebacterium glutamicum
  CDS (101)..(664): RXS03158
caaagctcaccgaaggcaccaacgccaagttggttgttgacaacaccttggcatccccatacctgcagcagccactaaaactcggcgcacacgcaagtccttgcactccaccaccaagtacatcgaaggacactccgacgttgttggcggccttgtgggtaccaacgaccaggaaatggacgaagaactgctgttcatgcagggcggcatcggaccgatcccatcagttttcgatgcatacctgaccgcccgtggcctcaagacccttgcagtgcgcatggatcgccactgcgacaacgcagaaaagatcgcggaattcctggactcccgcccagaggtctccaccgtgctctacccaggtctgaagaaccacccaggccacgaagtcgcagcgaagcagatgaagcgcttcggcggcatgatctccgtccgtttcgcaggcggcgaagaagcagctaagaagttctgtacctccaccaaactgatctgtctggccgagtccctcggtggcgtggaatccctcctggagcacccagcaaccatgacccaccagtcagctgccggctctcagctcgaggttccccgcgacctcgtgcgcatctccattggtattgaagacattgaagacctgctcgcagatgtcgagcaggccctcaataacctttagaaactatttggcggcaagca

SEQ ID NO: 192 - protein, 188 aa, Corynebacterium glutamicum
LHSTTKYIEGHSDVVGGLVGTNDQEMDEELLFMQGGIGPIPSVFDAYLTARGLKTLAVRMDRHCDNAEKIAEFLDSRPEVSTVLYPGLKNHPGHEVAAKQMKRFGGMISVRFAGGEEAAKKFCTSTKLICLAESLGGVESLLEHPATMTHQSAAGSQLEVPRDLVRISIGIEDIEDLLADVEQALNNL

SEQ ID NO: 193 - DNA, 617 bp, Corynebacterium glutamicum
  CDS (1)..(594): FRXA00254
cagccactaaaactcggcgcacacgcagtcttgcactccaccaccaagtacatcggaggacactccgacgttgttggcggccttgtggttaccaacgaccaggaaatggacgaagaactgctgttcatgcagggcggcatcggaccgatcccatcagttttcgatgcatacctgaccgcccgtggcctcaagacccttgcagtgcgcatggatcgccactgcgacaacgcagaaaagatcgcggaattcctggactcccgcccagaggtctccaccgtgctctacccaggtctgaagaaccacccaggccacgaagtcgcagcgaagcagatgaagcgcttcggcggcatgatctccgtccgtttcgcaggcggcgaagaagcagctaagaagttctgtacctccaccaaactgatctgtctggccgagtccctcggtggcgtggaatccctcctggagcacccagcaaccatgacccaccagtcagctgccggctctcagctcgaggttccccgcgacctcgtgcgcatctccattggtattgaagacattgaagacctgctcgcagatgtcgagcaggccctcaataacctttagaaactatttggcggcaagca

SEQ ID NO: 194 - protein, 198 aa, Corynebacterium glutamicum
QPLKLGAHAVLHSTTKYIGGHSDVVGGLVVTNDQEMDEELLFMQGGIGPIPSVFDAYLTARGLKTLAVRMDRHCDNAEKIAEFLDSRPEVSTVLYPGLKNHPGHEVAAKQMKRFGGMISVRFAGGEEAAKKFCTSTKLICLAESLGGVESLLEHPATMTHQSAAGSQLEVPRDLVRISIGIEDIEDLLADVEQALNNL

SEQ ID NO: 195 - DNA, 1170 bp, Corynebacterium glutamicum
  CDS (101)..(1147): RXA02532
gatgaatttttacccaccatctgtacctattaaccctgcgtggcgtccacccacagtaactgtgcaagcgggacggccagccagaactcctggtgcgccgatgaacccacctatcacgttgtccagcacttatgttcatgattcagaaaaagcttatgggcgcgatggcaatgatggatggggtgcatttgaggctgccatgggaactctagatggtgggttcgcggtatcttattcttcaggtttggcagcggcaacgtcgattgctgatttggttcctactggtggcacagttgttttacctaaagctgcctattatggcgtgaccaatattttcgccaggatggaagcccgcggaaggctgaaggttcgaactgttgatgcagacaataccgaagaagtgattgctgctgctcaaggtgcagatgtggtgtgggtggaatcgatcgctaatccgacgatggtggtagctgatatccctgcaatagtcgacggtgtgcgtgggcttggagttttgactgtcgttgacgcgactttcgcaacgccacttcgtcaacgtccattggaacttggtgctgatattgtgctttactcggcaaccaaacttatcggtggacactctgatcttcttcttggagtcgcagtgtgcaagtctgagcaccatgcgcagtttcttgccactcaccgtcatgatcatggttcagtgccgggaggtcttgaagcgtttcttgctctccgtggattgtattccttggcggtgcgtcttgatcgagcagaatccaacgcagcagaactttcgcggcgacttaacgcgcatccttcggttacccgcgtcaattatccaggacttcctgatgatccccaacatgaaaaagccgtgcgagtcctaccctctggatgtggaaacatgttgtcatttgagcttgatgcaacacctgaacgaactgatgagattctcgaaagcctgtcacttttaacccacgcgaccagttggggaggtgtggaaacagccattgaacgtcgcaccaggcgggatgctgaagtggtggcagaagtaccgatgactctttgccgcgtttccgtaggaattgaagacgttgaagatctatgggaagacctcaacgcctcaatcgacaaagttctgggttagaactcgtagccagtaaccag

SEQ ID NO: 196 - protein, 349 aa, Corynebacterium glutamicum
MNPPITLSSTYVHDSEKAYGRDGNDGWGAFEAAMGTLDGGFAVSYSSGLAAATSIADLVPTGGTVVLPKAAYYGVTNIFARMEARGRLKVRTVDADNTEEVIAAAQGADVVWVESIANPTMVVADIPAIVDGVRGLGVLTVVDATFATPLRQRPLELGADIVLYSATKLIGGHSDLLLGVAVCKSEHHAQFLATHRHDHGSVPGGLEAFLALRGLYSLAVRLDRAESNAAELSRRLNAHPSVTRVNYPGLPDDPQHEKAVRVLPSGCGNMLSFELDATPERTDEILESLSLLTHATSWGGVETAIERRTRRDAEVVAEVPMTLCRVSVGIEDVEDLWEDLNASIDKVLG

SEQ ID NO: 197 - DNA, 861 bp, Corynebacterium glutamicum
  CDS (101)..(838): RXS03159
aggggctagttttacacaaaagtggacagcttggtctatcattgccagaagaccggtccttttagggccatagaattctgattacaggagttgatctaccttgtcttttgacccaaacacccagggtttctccactgcatcgattcacgctgggtatgagccagacgactactacggttcgattaacaccccaatctatgcctccaccaccttcgcgcagaacgctccaaacgaactgcgcaaaggctacgagtacacccgtgtgggcaaccccaccatcgtggcattagagcagaccgtcgcagcactcgaaggcgcaaagtatggccgcgcattctcctccggcatggctgcaaccgacatcctgttccgcatcatcctcaagccgggcgatcacatcgtcctcggcaacgatgcttacggcggaacctaccgcctgatcgacaccgtattcaccgcatggggcgtcgaatacaccgttgttgatacctccgtcgtggaagaggtcaaggcagcgatcaaggacaacaccaagctgatctgggtggaaaccccaaccaacccagcacttggcatcaccgacatcgaagcagtagcaaagctcaccgaaggcaccaacgccaagttggttgttgacaacaccttggcatccccatacctgcagcagccactaaaactcggcgcacacgcaagtccttgcactccaccaccaagtacatcgaaggacactccgacgttgttggcggccttgtgggtaccaacgaccaggaaatggacgaagaactgctgttcatgcagggcggcatcggaccgatcccatcagttttcgatgcatacctgaccgcccgtggcctcaagacc

SEQ ID NO: 198 - protein, 246 aa, Corynebacterium glutamicum
LSFDPNTQGFSTASIHAGYEPDDYYGSINTPIYASTTFAQNAPNELRKGYEYTRVGNPTIVALEQTVAALEGAKYGRAFSSGMAATDILFRIILKPGDHIVLGNDAYGGTYRLIDTVFTAWGVEYTVVDTSVVEEVKAAIKDNTKLIWVETPTNPALGITDIEAVAKLTEGTNAKLVVDNTLASPYLQQPLKLGAHASPCTPPPSTSKDTPTLLAALWVPTTRKWTKNCCSCRAASDRSHQFSMHT

SEQ ID NO: 199 - DNA, 703 bp, Corynebacterium glutamicum
  CDS (101)..(703): FRXA02768
  misc_feature 676,687,690,691,693: n = a, g, c, or t
  VARIANT 192: Xaa = His or Gln
  VARIANT 196: Xaa = Ile, Thr, Asn, or Ser
  VARIANT 197: Xaa = Phe, Lys, Ser, Tyr, STOP, Cys, or Trp
  VARIANT 198: Xaa = Val, Ala, Glu, or Gly
aggggctagttttacacaaaagtggacagcttggtctatcattgccagaagaccggtccttttagggccatagaattctgattacaggagttgatctaccttgtcttttgacccaaacacccagggtttctccactgcatcgattcacgctgggtatgagccagacgactactacggttcgattaacaccccaatctatgcctccaccaccttcgcgcagaacgctccaaacgaactgcgcaaaggctacgagtacacccgtgtgggcaaccccaccatcgtggcattagagcagaccgtcgcagcactcgaaggcgcaaagtatggccgcgcattctcctccggcatggctgcaaccgacatcctgttccgcatcatcctcaagccgggcgatcacatcgtcctcggcaacgatgcttacggcggaacctaccgcctgatcgacaccgtattcaccgcatggggcgtcgaatacaccgttgttgatacctccgtcgtggaagaggtcaaggcagcgatcaaggacaacaccaaggctgatcttggtggaaaccccaaccaacccagcactttggcattacccgacatcgaagcagtntgcaaaacttcacccgaaaggcaccaaccccaagcttgttgtttgacaacaccttcgcattccccatacctgcagcanccacttaaaanttnngngcacacgcag

SEQ ID NO: 200 - protein, 201 aa, Corynebacterium glutamicum
  VARIANT 192: Xaa = His or Gln
  VARIANT 196: Xaa = Ile, Thr, Asn, or Ser
  VARIANT 197: Xaa = Phe, Lys, Ser, Tyr, STOP, Cys, or Trp
  VARIANT 198: Xaa = Val, Ala, Glu, or Gly
LSFDPNTQGFSTASIHAGYEPDDYYGSINTPIYASTTFAQNAPNELRKGYEYTRVGNPTIVALEQTVAALEGAKYGRAFSSGMAATDILFRIILKPGDHIVLGNDAYGGTYRLIDTVFTAWGVEYTVVDTSVVEEVKAAIKDNTKADLGGNPNQPSTLALPDIEAVCKTSPERHQPQACCLTTPSHSPYLQXPLKXXXHTQ

SEQ ID NO: 201 - DNA, 1113 bp, Corynebacterium glutamicum
  CDS (101)..(1090): RXA00216
gtgttgctcgcggccaggcagcagtgctgtacctgcctgacgcggatggtgacatcgttcttggatcaggcaccatctgccacacggagtcttaagaaaattgggcgcttatggtttaggtgagcttcctggaaaatccgccgcggaagccgccgacattattcagggtgaaacgggcgatcttctccatattcctcagcttccggcgcgaggtttgggtgctgatctgatcggtcgaaccgtcggtctgctggacatgatcaacgttgatcgcggggcccgatcttgggtgatgagcacacgccccagcagattgacgcacctgaccggcgatttccttgacatggatttggatgcgtgcgaggaaacctggggaacgggcgtcgacaagctaaaaatccaagttgctggtccctggactttaggtgcgcgcattgagttggccaatggccatcgcgttttgtctgatcgcggtgcgatgcgtgatctcacgcaggcgctgatcgccggcatcgatgcgcatgcacgcaaggttgctgggcgatttcgcgccgaagtgcaggtgcaaattgatgagccggagctgaaatcgcttatcgacggctccctccctggcacttccacctttgacattattcctgcggtgaatgtcgctgatgccagtgaacgtttgcagcaggtctttagctcgattgaggggccgacatatctcaacctcaccggccagattcctacttgggatgtggctcggggtgcgggcgccgatactgtgcagatttccatggatcaagtccgtggaaatgaacatttggatggttttggtgaaaccatcaccagtggaattcgtcttggtttgggcattacgacaggaaaagatgtcgtagatgaactgctcgagcgaccgcggcaaaaggccgttgaggtagcacgcttttttgatcgtttaggtgtgggccgaaactatctcgtggatgctgttgatattcatccgggtgaggatttggtgcaggggaccatcaccgaggccgcgcaggcttatcgcatggcccgggtgatgtcggagatgttgtcgaaggattcatgcgacctttaaggctttaccggcgctgggtg

SEQ ID NO: 202 - protein, 330 aa, Corynebacterium glutamicum
LGAYGLGELPGKSAAEAADIIQGETGDLLHIPQLPARGLGADLIGRTVGLLDMINVDRGARSWVMSTRPSRLTHLTGDFLDMDLDACEETWGTGVDKLKIQVAGPWTLGARIELANGHRVLSDRGAMRDLTQALIAGIDAHARKVAGRFRAEVQVQIDEPELKSLIDGSLPGTSTFDIIPAVNVADASERLQQVFSSIEGPTYLNLTGQIPTWDVARGAGADTVQISMDQVRGNEHLDGFGETITSGIRLGLGITTGKDVVDELLERPRQKAVEVARFFDRLGVGRNYLVDAVDIHPGEDLVQGTITEAAQAYRMARVMSEMLSKDSCDL

SEQ ID NO: 203 - DNA, 623 bp, Corynebacterium glutamicum
  CDS (1)..(600): RXN00402
actgacgaaaaggatggaaagccagtattgccctacttcgtcactccagatgctgcttaccacggattgaagtacgcagaccttggtgcaccagccttcggcctcaaggttcgcgttggccttctacgcgacaccggctccaccctctccgcattcaacgcatgggctgcagtccagggcatcgacaccctttccctgcgcctggagcgccacaacgaaaacgccatcaaggttgcagaattcctcaacaaccacgagaaggtggaaaaggttaacttcgcaggcctgaaggattccccttggtacgcaaccaaggaaaagcttggcctgaagtacaccggctccgttctcaccttcgagatcaagggcggcaaggatgaggcttgggcatttatcgacgccctgaagctacactccaaccttgcaaacatcggcgatgttcgctccctcgttgttcacccagcaaccaccacccattcacagtccgacgaagctggcctggcacgcgcgggcgttacccagtccaccgtccgcctgtccgttggcatcgagaccattgatgatatcatcgctgacctcgaaggcggctttgctgcaatctagctttaaatagactcacccca

SEQ ID NO: 204 - protein, 200 aa, Corynebacterium glutamicum
TDEKDGKPVLPYFVTPDAAYHGLKYADLGAPAFGLKVRVGLLRDTGSTLSAFNAWAAVQGIDTLSLRLERHNENAIKVAEFLNNHEKVEKVNFAGLKDSPWYATKEKLGLKYTGSVLTFEIKGGKDEAWAFIDALKLHSNLANIGDVRSLVVHPATTTHSQSDEAGLARAGVTQSTVRLSVGIETIDDIIADLEGGFAAI

SEQ ID NO: 205 - DNA, 599 bp, Corynebacterium glutamicum
  CDS (1)..(576): FRXA00402
gtattgccctacttcgtcactccagatgctgcttaccacggattgaagtacgcagaccttggtgcaccagccttcggcctcaaggttcgcgttggccttctacgcgacaccggctccaccctctccgcattcaacgcatgggctgcagtccagggcatcgacaccctttccctgcgcctggagcgccacaacgaaaacgccatcaaggttgcagaattcctcaacaaccacgagaaggtggaaaaggttaacttcgcaggcctgaaggattccccttggtacgcaaccaaggaaaagcttggcctgaagtacaccggctccgttctcaccttcgagatcaagggcggcaaggatgaggcttgggcatttatcgacgccctgaagctacactccaaccttgcaaacatcggcgatgttcgctccctcgttgttcacccagcaaccaccacccattcacagtccgacgaagctggcctggcacgcgcgggcgttacccagtccaccgtccgcctgtccgttggcatcgagaccattgatgatatcatcgctgacctcgaaggcggctttgctgcaatctagctttaaatagactcacccca

SEQ ID NO: 206 - protein, 192 aa, Corynebacterium glutamicum
VLPYFVTPDAAYHGLKYADLGAPAFGLKVRVGLLRDTGSTLSAFNAWAAVQGIDTLSLRLERHNENAIKVAEFLNNHEKVEKVNFAGLKDSPWYATKEKLGLKYTGSVLTFEIKGGKDEAWAFIDALKLHSNLANIGDVRSLVVHPATTTHSQSDEAGLARAGVTQSTVRLSVGIETIDDIIADLEGGFAAI

SEQ ID NO: 207 - DNA, 613 bp, Corynebacterium glutamicum
  CDS (101)..(613): RXA00405
agaataaatttataccacacagtctattgcaatagaccaagctgttcagtagggtgcatgggagaagaatttcctaataaaaactcttaaggacctccaaatgccaaagtacgacaattccaatgctgaccagtggggctttgaaacccgctccattcacgcaggccagtcagtagacgcacagaccagcgcacgaaaccttccgatctaccaatccaccgctttcgtgttcgactccgctgagcacgccaagcagcgtttcgcacttgaggatctaggccctgtttactcccgcctcaccaacccaaccgttgaggctttggaaaaccgcatcgcttccctcgaaggtggcgtccacgctgtagcgttctcctccggacaggccgcaaccaccaacgccattttgaacctggcaggagcgggcgaccacatcgtcacctccccacgcctctacggtggcaccgagactctattccttatcactcttaaccgcctgggtatcgatgtttccttcgtggaaaaccccgacgaccctgagtcctggcaggcagccgttcagccaaacaccaaagcattcttcggcgagactttcgccaacccacaggcagacgtc

SEQ ID NO: 208 - protein, 171 aa, Corynebacterium glutamicum
MPKYDNSNADQWGFETRSIHAGQSVDAQTSARNLPIYQSTAFVFDSAEHAKQRFALEDLGPVYSRLTNPTVEALENRIASLEGGVHAVAFSSGQAATTNAILNLAGAGDHIVTSPRLYGGTETLFLITLNRLGIDVSFVENPDDPESWQAAVQPNTKAFFGETFANPQADV

SEQ ID NO: 209 - DNA, 551 bp, Corynebacterium glutamicum
  CDS (1)..(528): RXA02197
gccgaacgcatgcgctttagcttcccacgccagcagcgcggcaggttcttgtgcatcgcggatttcattcgcccacgcgagcaagctgtcaaggacggccaagtggacgtcatgccattccagctggtcaccatgggtaatcctattgctgatttcgccaacgagttgttcgcagccaatgaataccgcgagtacttggaagttcacggcatcggcgtgcagctcaccgaagcattggccgagtactggcactcccgagtgcgcagcgaactcaagctgaacgacggtggatctgtcgctgattttgatccagaagacaagaccaagttcttcgacctggattaccgcggcgcccgcttctcctttggttacggttcttgccctgatctggaagaccgcgcaaagctggtggaattgctcgagccaggccgtatcggcgtggagttgtccgaggaactccagctgcacccagagcagtccacagacgcgtttgtgctctaccacccagaggcaaagtactttaacgtctaacacctttgagagggaaaact

SEQ ID NO: 210 - protein, 176 aa, Corynebacterium glutamicum
AERMRFSFPRQQRGRFLCIADFIRPREQAVKDGQVDVMPFQLVTMGNPIADFANELFAANEYREYLEVHGIGVQLTEALAEYWHSRVRSELKLNDGGSVADFDPEDKTKFFDLDYRGARFSFGYGSCPDLEDRAKLVELLEPGRIGVELSEELQLHPEQSTDAFVLYHPEAKYFNV

SEQ ID NO: 211 - DNA, 2599 bp, Corynebacterium glutamicum
  CDS (101)..(2599): RXN02198
agactagtggcgctttgcctgtgttgcttaggcggcgttgaaaatgaactacgaatgaaaagttcgggaattgtctaatccgtactaagctgtctacacaatgtctacttcagttacttcaccagcccacaacaacgcacattcctccgaatttttggatgcgttggcaaaccatgtgttgatcggcgacggcgccatgggcacccagctccaaggctttgacctggacgtggaaaaggatttccttgatctggaggggtgtaatgagattctcaacgacacccgccctgatgtgttgaggcagattcaccgcgcctactttgaggcgggagctgacttggttgagaccaatacttttggttgcaacctgccgaacttggcggattatgacatcgctgatcgttgccgtgagcttgcctacaagggcactgcagtggctagggaagtggctgatgagatggggccgggccgaaacggcatgcggcgtttcgtggttggttccctgggacctggaacgaagcttccatcgctgggccatgcaccgtatgcagatttgcgtgggcactacaaggaagcagcgcttggcatcatcgacggtggtggcgatgcctttttgattgagactgctcaggacttgcttcaggtcaaggctgcggttcacggcgttcaagatgccatggctgaacttgatacattcttgcccattatttgccacgtcaccgtagagaccaccggcaccatgctcatgggttctgagatcggtgccgcgttgacagcgctgcagccactgggtatcgacatgattggtctgaactgcgccaccggcccagatgagatgagcgagcacctgcgttacctgtccaagcacgccgatattcctgtgtcggtgatgcctaacgcaggtcttcctgtcctgggtaaaaacggtgcagaatacccacttgaggctgaggatttggcgcaggcgctggctggattcgtctccgaatatggcctgtccatggtgggtggttgttgtggcaccacacctgagcacatccgtgcggtccgcgatgcggtggttggtgttccagagcaggaaacctccacactgaccaagatccctgcaggccctgttgagcaggcctcccgcgaggtggagaaagaggactccgtcgcgtcgctgtacacctcggtgccattgtcccaggaaaccggcatttccatgatcggtgagcgcaccaactccaacggttccaaggcattccgtgaggcaatgctgtctggcgattgggaaaagtgtgtggatattgccaagcagcaaacccgcgatggtgcacacatgctggatctttgtgtggattacgtgggacgagacggcaccgccgatatggcgaccttggcagcacttcttgctaccagctccactttgccaatcatgattgactccaccgagccagaggttattcgcacaggccttgagcacttgggtggacgaagcatcgttaactccgtcaactttgaagacggcgatggccctgagtcccgctaccagcgcatcatgaaactggtaaagcagcacggtgcggccgtggttgcgctgaccattgatgaggaaggccaggcacgtaccgctgagcacaaggtgcgcattgctaaacgactgattgacgatatcaccggcagctacggcctggatatcaaagacatcgttgtggactgcctgaccttcccgatctctactggccaggaagaaaccaggcgagatggcattgaaaccatcgaagccatccgcgagctgaagaagctctacccagaaatccacaccaccctgggtctgtccaatatttccttcggcctgaaccctgctgcacgccaggttcttaactctgtgttcctcaatgagtgcattgaggctggtctggactctgcgattgcgcacagctccaagattttgccgatgaaccgcattgatgatcgccagcgcgaagtggcgttggatatggtctatgatcgccgcaccgaggattacgatccgctgcaggaattcatgcagctgtttgagggcgtttctgctgccgatgccaaggatgctcgcgctgaacagctggccgctatgcctttgtttgagcgtttggcacagcgcatcatcgacggcgataagaatggccttgaggatgatctggaagcaggcatgaaggagaagtctcctattgcgatcatcaacgaggaccttctcaacggcatgaagaccgtgggtgagctgtttggttccggacagatgcagctgccattcgtgctgcaatcggcagaaaccatgaaaactgcggtggcctatttggaaccgttcatggaagaggaagcagaagctaccggatctgcgcaggcagagggcaagggcaaaatcgtcgtggccaccgtcaagggtgacgtgcacgatatcggcaagaacttggtggacatcattttgtccaacaacggttacgacgtggtgaacttgggcatcaagcagccactgtccgccatgttggaagcagcggaagaacacaaagcagacgtcatcggcatgtcgggacttcttgtgaagtccaccgtggtgatgaagcaaaccatcagcgac

SEQ ID NO: 212 - protein, 833 aa, Corynebacterium glutamicum
MSTSVTSPAHNNAHSSEFLDALANHVLIGDGAMGTQLQGFDLDVEKDFLDLEGCNEILNDTRPDVLRQIHRAYFEAGADLVETNTFGCNLPNLADYDIADRCRELAYKGTAVAREVADEMGPGRNGMRRFVVGSLGPGTKLPSLGHAPYADLRGHYKEAALGIIDGGGDAFLIETAQDLLQVKAAVHGVQDAMAELDTFLPIICHVTVETTGTMLMGSEIGAALTALQPLGIDMIGLNCATGPDEMSEHLRYLSKHADIPVSVMPNAGLPVLGKNGAEYPLEAEDLAQALAGFVSEYGLSMVGGCCGTTPEHIRAVRDAVVGVPEQETSTLTKIPAGPVEQASREVEKEDSVASLYTSVPLSQETGISMIGERTNSNGSKAFREAMLSGDWEKCVDIAKQQTRDGAHMLDLCVDYVGRDGTADMATLAALLATSSTLPIMIDSTEPEVIRTGLEHLGGRSIVNSVNFEDGDGPESRYQRIMKLVKQHGAAVVALTIDEEGQARTAEHKVRIAKRLIDDITGSYGLDIKDIVVDCLTFPISTGQEETRRDGIETIEAIRELKKLYPEIHTTLGLSNISFGLNPAARQVLNSVFLNECIEAGLDSAIAHSSKILPMNRIDDRQREVALDMVYDRRTEDYDPLQEFMQLFEGVSAADAKDARAEQLAAMPLFERLAQRIIDGDKNGLEDDLEAGMKEKSPIAIINEDLLNGMKTVGELFGSGQMQLPFVLQSAETMKTAVAYLEPFMEEEAEATGSAQAEGKGKIVVATVKGDVHDIGKNLVDIILSNNGYDVVNLGIKQPLSAMLEAAEEHKADVIGMSGLLVKSTVVMKQTISD

SEQ ID NO: 213 - DNA, 2578 bp, Corynebacterium glutamicum
  CDS (101)..(2578): FRXA02198
agactagtggcgctttgcctgtgttgcttaggcggcgttgaaaatgaactacgaatgaaaagttcgggaattgtctaatccgtactaagctgtctacacaatgtctacttcagttacttcaccagcccacaacaacgcacattcctccgaatttttggatgcgttggcaaaccatgtgttgatcggcgacggcgccatgggcacccagctccaaggctttgacctggacgtggaaaaggatttccttgatctggaggggtgtaatgagattctcaacgacacccgccctgatgtgttgaggcagattcaccgcgcctactttgaggcgggagctgacttggttgagaccaatacttttggttgcaacctgccgaacttggcggattatgacatcgctgatcgttgccgtgagcttgcctacaagggcactgcagtggctagggaagtggctgatgagatggggccgggccgaaacggcatgcggcgtttcgtggttggttccctgggacctggaacgaagcttccatcgctgggccatgcaccgtatgcagatttgcgtgggcactacaaggaagcagcgcttggcatcatcgacggtggtggcgatgcctttttgattgagactgctcaggacttgcttcaggtcaaggctgcggttcacggcgttcaagatgccatggctgaacttgatacattcttgcccattatttgccacgtcaccgtagagaccaccggcaccatgctcatgggttctgagatcggtgccgcgttgacagcgctgcagccactgggtatcgacatgattggtctgaactgcgccaccggcccagatgagatgagcgagcacctgcgttacctgtccaagcacgccgatattcctgtgtcggtgatgcctaacgcaggtcttcctgtcctgggtaaaaacggtgcagaatacccacttgaggctgaggatttggcgcaggcgctggctggattcgtctccgaatatggcctgtccatggtgggtggttgttgtggcaccacacctgagcacatccgtgcggtccgcgatgcggtggttggtgttccagagcaggaaacctccacactgaccaagatccctgcaggccctgttgagcaggcctcccgcgaggtggagaaagaggactccgtcgcgtcgctgtacacctcggtgccattgtcccaggaaaccggcatttccatgatcggtgagcgcaccaactccaacggttccaaggcattccgtgaggcaatgctgtctggcgattgggaaaagtgtgtggatattgccaagcagcaaacccgcgatggtgcacacatgctggatctttgtgtggattacgtgggacgagacggcaccgccgatatggcgaccttggcagcacttcttgctaccagctccactttgccaatcatgattgactccaccgagccagaggttattcgcacaggccttgagcacttgggtggacgaagcatcgttaactccgtcaactttgaagacggcgatggccctgagtcccgctaccagcgcatcatgaaactggtaaagcagcacggtgcggccgtggttgcgctgaccattgatgaggaaggccaggcacgtaccgctgagcacaaggtgcgcattgctaaacgactgattgacgatatcaccggcagctacggcctggatatcaaagacatcgttgtggactgcctgaccttcccgatctctactggccaggaagaaaccaggcgagatggcattgaaaccatcgaagccatccgcgagctgaagaagctctacccagaaatccacaccaccctgggtctgtccaatatttccttcggcctgaaccctgctgcacgccaggttcttaactctgtgttcctcaatgagtgcattgaggctggtctggactctgcgattgcgcacagctccaagattttgccgatgaaccgcattgatgatcgccagcgcgaagtggcgttggatatggtctatgatcgccgcaccgaggattacgatccgctgcaggaattcatgcagctgtttgagggcgtttctgctgccgatgccaaggatgctcgcgctgaacagctggccgctatgcctttgtttgagcgtttggcacagcgcatcatcgacggcgataagaatggccttgaggatgatctggaagcaggcatgaaggagaagtctcctattgcgatcatcaacgaggaccttctcaacggcatgaagaccgtgggtgagctgtttggttccggacagatgcagctgccattcgtgctgcaatcggcagaaaccatgaaaactgcggtggcctatttggaaccgttcatggaagaggaagcagaagctaccggatctgcgcaggcagagggcaagggcaaaatcgtcgtggccaccgtcaagggtgacgtgcacgatatcggcaagaacttggtggacatcattttgtccaacaacggttacgacgtggtgaacttgggcatcaagcagccactgtccgccatgttggaagcagcggaagaacacaaagcagacgtcatcggcatgtcgggacttcttgtgaagtccaccgtggtg

SEQ ID NO: 214 - protein, 826 aa, Corynebacterium glutamicum
MSTSVTSPAHNNAHSSEFLDALANHVLIGDGAMGTQLQGFDLDVEKDFLDLEGCNEILNDTRPDVLRQIHRAYFEAGADLVETNTFGCNLPNLADYDIADRCRELAYKGTAVAREVADEMGPGRNGMRRFVVGSLGPGTKLPSLGHAPYADLRGHYKEAALGIIDGGGDAFLIETAQDLLQVKAAVHGVQDAMAELDTFLPIICHVTVETTGTMLMGSEIGAALTALQPLGIDMIGLNCATGPDEMSEHLRYLSKHADIPVSVMPNAGLPVLGKNGAEYPLEAEDLAQALAGFVSEYGLSMVGGCCGTTPEHIRAVRDAVVGVPEQETSTLTKIPAGPVEQASREVEKEDSVASLYTSVPLSQETGISMIGERTNSNGSKAFREAMLSGDWEKCVDIAKQQTRDGAHMLDLCVDYVGRDGTADMATLAALLATSSTLPIMIDSTEPEVIRTGLEHLGGRSIVNSVNFEDGDGPESRYQRIMKLVKQHGAAVVALTIDEEGQARTAEHKVRIAKRLIDDITGSYGLDIKDIVVDCLTFPISTGQEETRRDGIETIEAIRELKKLYPEIHTTLGLSNISFGLNPAARQVLNSVFLNECIEAGLDSAIAHSSKILPMNRIDDRQREVALDMVYDRRTEDYDPLQEFMQLFEGVSAADAKDARAEQLAAMPLFERLAQRIIDGDKNGLEDDLEAGMKEKSPIAIINEDLLNGMKTVGELFGSGQMQLPFVLQSAETMKTAVAYLEPFMEEEAEATGSAQAEGKGKIVVATVKGDVHDIGKNLVDIILSNNGYDVVNLGIKQPLSAMLEAAEEHKADVIGMSGLLVKSTVV

SEQ ID NO: 215 - DNA, 621 bp, Corynebacterium glutamicum
  CDS (101)..(598): RXN03074
tttgtgggcaatctggttttttcgtaattgtgtgggatgaatctcttaaaaattcacatttagcaggacaagcatactgttttagttctatgctgtgggcatgactcaaagtgctccagaattcattgccaccgcagacctcgtagacatcatcggcgacaacgcgcaatcatgcgacactcagtttcaaaaccttggaggtgccacagaattccacggaataataaccaccgtgaaatgcttccaagacaacgccctcctgaaatccatcctgagcgaggataatcctgggggagtgctggttatcgatggcgacgcatccgtgcacaccgcgctagttggcgacatcattgcaggacttggaaaagatcatggttggtccggagtaattgtcaacggagcaattcgagactccgcagtcatcggcaccatgacctttggttgtaaagcccttggaaccaacccgcggaaatccactaaaactggttccggcgaacgagacgtagtggtatcgattggtggcattgacttcattcctggtcattacgtctacgcggactctgacggaattatcgtcaccgaggcgccaattaagcagtaatttgttttgacgacgcagta

SEQ ID NO: 216 - protein, 166 aa, Corynebacterium glutamicum
MTQSAPEFIATADLVDIIGDNAQSCDTQFQNLGGATEFHGIITTVKCFQDNALLKSILSEDNPGGVLVIDGDASVHTALVGDIIAGLGKDHGWSGVIVNGAIRDSAVIGTMTFGCKALGTNPRKSTKTGSGERDVVVSIGGIDFIPGHYVYADSDGIIVTEAPIKQ

SEQ ID NO: 217 - DNA, 621 bp, Corynebacterium glutamicum; identical to SEQ ID NO: 215
  CDS (101)..(598): FRXA02906

SEQ ID NO: 218 - protein, 166 aa, Corynebacterium glutamicum; identical to SEQ ID NO: 216

SEQ ID NO: 219 - DNA, 1557 bp, Corynebacterium glutamicum
  CDS (101)..(1534): RXN00132
aacagcttcaatcaattcggtgtccactccaacatgtagagtggtgcgcgttaaaaaagttttcctaattttcattttcttaaaaggagctcgccaggacatggcacaggttatggacttcaaggttgccgatctttcactagcagaggcaggacgtcaccagattcgtcttgcagagtatgagatgccaggtctcatgcagttgcgcaaggaattcgcagacgagcagcctttgaagggcgcccgaattgctggttctatccacatgacggtccagaccgccgtgcttattgagaccctcactgctttgggcgctgaggttcgttgggcttcctgcaacattttctccacccaggatgaggctgcagcggctatcgttgtcggctccggcaccgtcgaagagccagctggtgttccagtattcgcgtggaagggtgagtcactggaggagtactggtggtgcatcaaccagatcttcagctggggcgatgagctgccaaacatgatcctcgacgacggcggtgacgccaccatggctgttattcgcggtcgcgaatacgagcaggctggtctggttccaccagcagaggccaacgattccgatgagtacatcgcattcttgggcatgctgcgtgaggttcttgctgcagagcctggcaagtggggcaagatcgctgaggccgttaagggtgtcaccgaggaaaccaccaccggtgtgcaccgcctgtaccacttcgctgaagaaggcgtgctgcctttcccagcgatgaacgtcaacgacgctgtcaccaagtccaagtttgataacaagtacggcacccgccactccctgatcgacggcatcaaccgcgccactgacatgctcatgggcggcaagaacgtgcttgtctgcggttacggcgatgtcggcaagggctgcgctgaggctttcgacggccagggcgctcgcgtcaaggtcaccgaagctgacccaatcaacgctcttcaggctctgatggatggctactctgtggtcaccgttgatgaggccatcgaggacgccgacatcgtgatcaccgcgaccggcaacaaggacatcatttccttcgagcagatgctcaagatgaaggatcacgctctgctgggcaacatcggtcactttgataatgagatcgatatgcattccctgttgcaccgcgacgacgtcacccgcaccacgatcaagccacaggtcgacgagttcaccttctccaccggtcgctccatcatcgtcctgtccgaaggtcgcctgttgaaccttggcaacgccaccggacacccatcatttgtcatgtccaactctttcgccgatcagaccattgcgcagatcgaactgttccaaaacgaaggacagtacgagaacgaggtctaccgtctgcctaaggttctcgacgaaaaggtggcacgcatccacgttgaggctctcggcggtcagctcaccgaactgaccaaggagcaggctgagtacatcggcgttgacgttgcaggcccattcaagccggagcactaccgctactaatgattgtcagcattgaggga

SEQ ID NO: 220 - protein, 478 aa, Corynebacterium glutamicum
MAQVMDFKVADLSLAEAGRHQIRLAEYEMPGLMQLRKEFADEQPLKGARIAGSIHMTVQTAVLIETLTALGAEVRWASCNIFSTQDEAAAAIVVGSGTVEEPAGVPVFAWKGESLEEYWWCINQIFSWGDELPNMILDDGGDATMAVIRGREYEQAGLVPPAEANDSDEYIAFLGMLREVLAAEPGKWGKIAEAVKGVTEETTTGVHRLYHFAEEGVLPFPAMNVNDAVTKSKFDNKYGTRHSLIDGINRATDMLMGGKNVLVCGYGDVGKGCAEAFDGQGARVKVTEADPINALQALMDGYSVVTVDEAIEDADIVITATGNKDIISFEQMLKMKDHALLGNIGHFDNEIDMHSLLHRDDVTRTTIKPQVDEFTFSTGRSIIVLSEGRLLNLGNATGHPSFVMSNSFADQTIAQIELFQNEGQYENEVYRLPKVLDEKVARIHVEALGGQLTELTKEQAEYIGVDVAGPFKPEHYRY

SEQ ID NO: 221 - DNA, 128 bp, Corynebacterium glutamicum
  CDS (1)..(105): FRXA00132
cacgttgaggctctcggcggtcagctcaccgaactgaccaaggagcaggctgagtacatcggcgttgacgttgcaggcccattcaagccggagcactaccgctactaatgattgtcagcattgaggga

SEQ ID NO: 222 - protein, 35 aa, Corynebacterium glutamicum
HVEALGGQLTELTKEQAEYIGVDVAGPFKPEHYRY

SEQ ID NO: 223 - DNA, 1396 bp, Corynebacterium glutamicum
  CDS (101)..(1396): FRXA01371
aacagcttcaatcaattcggtgtccactccaacatgtagagtggtgcgcgttaaaaaagttttcctaattttcattttcttaaaaggagctcgccaggacatggcacaggttatggacttcaaggttgccgatctttcactagcagaggcaggacgtcaccagattcgtcttgcagagtatgagatgccaggtctcatgcagttgcgcaaggaattcgcagacgagcagcctttgaagggcgcccgaattgctggttctatccacatgacggtccagaccgccgtgcttattgagaccctcactgctttgggcgctgaggttcgttgggcttcctgcaacattttctccacccaggatgaggctgcagcggctatcgttgtcggctccggcaccgtcgaagagccagctggtgttccagtattcgcgtggaagggtgagtcactggaggagtactggtggtgcatcaaccagatcttcagctggggcgatgagctgccaaacatgatcctcgacgacggcggtgacgccaccatggctgttattcgcggtcgcgaatacgagcaggctggtctggttccaccagcagaggccaacgattccgatgagtacatcgcattcttgggcatgctgcgtgaggttcttgctgcagagcctggcaagtggggcaagatcgctgaggccgttaagggtgtcaccgaggaaaccaccaccggtgtgcaccgcctgtaccacttcgctgaagaaggcgtgctgcctttcccagcgatgaacgtcaacgacgctgtcaccaagtccaagtttgataacaagtacggcacccgccactccctgatcgacggcatcaaccgcgccactgacatgctcatgggcggcaagaacgtgcttgtctgcggttacggcgatgtcggcaagggctgcgctgaggctttcgacggccagggcgctcgcgtcaaggtcaccgaagctgacccaatcaacgctcttcaggctctgatggatggctactctgtggtcaccgttgatgaggccatcgaggacgccgacatcgtgatcaccgcgaccggcaacaaggacatcatttccttcgagcagatgctcaagatgaaggatcacgctctgctgggcaacatcggtcactttgataatgagatcgatatgcattccctgttgcaccgcgacgacgtcacccgcaccacgatcaagccacaggtcgacgagttcaccttctccaccggtcgctccatcatcgtcctgtccgaaggtcgcctgttgaaccttggcaacgccaccggacacccatcatttgtcatgtccaactctttcgccgatcagaccattgcgcagatcgaactgttccaaaacgaaggacagtacgagaacgaggtctaccgtctg

SEQ ID NO: 224 - protein, 432 aa, Corynebacterium glutamicum
MAQVMDFKVADLSLAEAGRHQIRLAEYEMPGLMQLRKEFADEQPLKGARIAGSIHMTVQTAVLIETLTALGAEVRWASCNIFSTQDEAAAAIVVGSGTVEEPAGVPVFAWKGESLEEYWWCINQIFSWGDELPNMILDDGGDATMAVIRGREYEQAGLVPPAEANDSDEYIAFLGMLREVLAAEPGKWGKIAEAVKGVTEETTTGVHRLYHFAEEGVLPFPAMNVNDAVTKSKFDNKYGTRHSLIDGINRATDMLMGGKNVLVCGYGDVGKGCAEAFDGQGARVKVTEADPINALQALMDGYSVVTVDEAIEDADIVITATGNKDIISFEQMLKMKDHALLGNIGHFDNEIDMHSLLHRDDVTRTTIKPQVDEFTFSTGRSIIVLSEGRLLNLGNATGHPSFVMSNSFADQTIAQIELFQNEGQYENEVYRL

SEQ ID NO: 225 - DNA, 2358 bp, Corynebacterium glutamicum
  CDS (101)..(2335): RXN02085
cacccggtgatttcgcgaaccttgaaacatcgtcagaagattgccgtgcgtcctagccgggatccgcacgttcggctcaagcagaaagtctttaactcacatgacttccaacttttcttccactgtcgctggtcttcctcgcatcggagcgaagcgtgaactgaagttcgcgctcgaaggctactggaatggatcaattgaaggtcgcgaacttgcgcagaccgcccgccaattggtcaacactgcatcggattctttgtctggattggattccgttccgtttgcaggacgttcctactacgacgcaatgctcgataccgccgctattttgggtgtgctgccggagcgttttgatgacatcgctgatcatgaaaacgatggtctcccactgtggattgaccgctactttggcgctgctcgcggtactgagaccctgcctgcacaggcaatgaccaagtggtttgataccaactaccactacctcgtgccggagttgtctgcggatacacgtttcgttttggatgcgtccgcgctgattgaggatctccgttgccagcaggttcgtggcgttaatgcccgccctgttctggttggtccactgactttcctttcccttgctcgcaccactgatggttccaatcctttggatcacctgcctgcactgtttgaggtctacgagcgcctcatcaagtctttcgatactgagtgggttcagatcgatgagcctgcgttggtcaccgatgttgctcctgaggttttggagcaggtccgcgctggttacaccactttggctaagcgcgatggcgtgtttgtcaatacttacttcggctctggcgatcaggcgctgaacactcttgcgggcatcggccttggcgcgattggcgttgacttggtcacccatggcgtcactgagcttgctgcgtggaagggtgaggagctgctggttgcgggcatcgttgatggtcgtaacatttggcgcaccgacctgtgtgctgctcttgcttccctgaagcgcctggcagctcgcggcccaatcgcagtgtctacctcttgttcactgctgcacgttccttacaccctcgaggctgagaacattgagcctgaggtccgcgactggcttgccttcggctcggagaagatcaccgaggtcaagctgcttgccgacgccctagccggcaacatcgacgcggctgcgttcgatgcggcgtccgcagcaattgcttctcgacgcacctccccacgcaccgcaccaatcacgcaggaactccctggccgtagccgtggatccttcgacactcgtgttacgctgcaggagaagtcactggagcttccagctctgccaaccaccaccattggttctttcccacagaccccatccattcgttctgctcgcgctcgtctgcgcaaggaatccatcactttggagcagtacgaagaggcaatgcgcgaagaaatcgatctggtcatcgccaagcaggaagaacttggtcttgatgtgttggttcacggtgagccagagcgcaacgacatggttcagtacttctctgaacttctcgacggtttcctctcaaccgccaacggctgggtccaaagctacggctcccgctgtgttcgtcctccagtgttgttcggaaacgtttcccgcccagcgccaatgactgtcaagtggttccagtacgcacagagcctgacccagaagcatgtcaagggaatgctcaccggtccagtcaccatccttgcatggtccttcgttcgcgatgatcagccgctggctaccactgctgaccaggttgcactggcactgcgcgatgaaattaacgatctcatcgaggctggcgcgaagatcatccaggtggatgagcctgcgattcgtgaactgttgccgctacgagacgtcgataagcctgcctacctgcagtggtccgtggactccttccgcctggcgactgccggcgcacccgacgacgtccaaatccacacccacatgtgctactccgagttcaacgaagtgatctcctcggtcatcgcgttggatgccgatgtcaccaccatcgaagcagcacgttccgacatgcaggtcctcgctgctctgaaatcttccggcttcgagctcggcgtcggacctggtgtgtgggatatccactccccgcgcgttccttccgcgcagaaagtggacggtctcctcgaggctgcactgcagtccgtggatcctcgccagctgtgggtcaacccagactgtggtctgaagacccgtggatggccagaagtggaagcttccctaaaggttctcgttgagtccgctaagcaggctcgtgagaaaatcggagcaactatctaaattgggttaccgctaggaac

SEQ ID NO: 226 - protein, 745 aa, Corynebacterium glutamicum
MTSNFSSTVAGLPRIGAKRELKFALEGYWNGSIEGRELAQTARQLVNTASDSLSGLDSVPFAGRSYYDAMLDTAAILGVLPERFDDIADHENDGLPLWIDRYFGAARGTETLPAQAMTKWFDTNYHYLVPELSADTRFVLDASALIEDLRCQQVRGVNARPVLVGPLTFLSLARTTDGSNPLDHLPALFEVYERLIKSFDTEWVQIDEPALVTDVAPEVLEQVRAGYTTLAKRDGVFVNTYFGSGDQALNTLAGIGLGAIGVDLVTHGVTELAAWKGEELLVAGIVDGRNIWRTDLCAALASLKRLAARGPIAVSTSCSLLHVPYTLEAENIEPEVRDWLAFGSEKITEVKLLADALAGNIDAAAFDAASAAIASRRTSPRTAPITQELPGRSRGSFDTRVTLQEKSLELPALPTTTIGSFPQTPSIRSARARLRKESITLEQYEEAMREEIDLVIAKQEELGLDVLVHGEPERNDMVQYFSELLDGFLSTANGWVQSYGSRCVRPPVLFGNVSRPAPMTVKWFQYAQSLTQKHVKGMLTGPVTILAWSFVRDDQPLATTADQVALALRDEINDLIEAGAKIIQVDEPAIRELLPLRDVDKPAYLQWSVDSFRLATAGAPDDVQIHTHMCYSEFNEVISSVIALDADVTTIEAARSDMQVLAALKSSGFELGVGPGVWDIHSPRVPSAQKVDGLLEAALQSVDPRQLWVNPDCGLKTRGWPEVEASLKVLVESAKQAREKIGATI

SEQ ID NO: 227 - DNA, 1923 bp, Corynebacterium glutamicum
  CDS (101)..(1900): FRXA02085
cacccggtgatttcgcgaaccttgaaacatcgtcagaagattgccgtgcgtcctagccgggatccgcacgttcggctcaagcagaaagtctttaactcacatgacttccaacttttcttccactgtcgctggtcttcctcgcatcggagcgaagcgtgaactgaagttcgcgctcgaaggctactggaatggatcaattgaaggtcgcgaacttgcgcagaccgcccgccaattggtcaacactgcatcggattctttgtctggattggattccgttccgtttgcaggacgttcctactacgacgcaatgctcgataccgccgctattttgggtgtgctgccggagcgttttgatgacatcgctgatcatgaaaacgatggtctcccactgtggattgaccgctactttggcgctgctcgcggtactgagaccctgcctgcacaggcaatgaccaagtggtttgataccaactaccactacctcgtgccggagttgtctgcggatacacgtttcgttttggatgcgtccgcgctgattgaggatctccgttgccagcaggttcgtggcgttaatgcccgccctgttctggttggtccactgactttcctttcccttgctcgcaccactgatggttccaatcctttggatcacctgcctgcactgtttgaggtctacgagcgcctcatcaagtctttcgatactgagtgggttcagatcgatgagcctgcgttggtcaccgatgttgctcctgaggttttggagcaggtccgcgctggttacaccactttggctaagcgcgatggcgtgtttgtcaatacttacttcggctctggcgatcaggcgctgaacactcttgcgggcatcggccttggcgcgattggcgttgacttggtcacccatggcgtcactgagcttgctgcgtggaagggtgaggagctgctggttgcgggcatcgttgatggtcgtaacatttggcgcaccgacctgtgtgctgctcttgcttccctgaagcgcctggcagctcgcggcccaatcgcagtgtctacctcttgttcactgctgcacgttccttacaccctcgaggctgagaacattgagcctgaggtccgcgactggcttgccttcggctcggagaagatcaccgaggtcaagctgcttgccgacgccctagccggcaacatcgacgcggctgcgttcgatgcggcgtccgcagcaattgcttctcgacgcacctccccacgcaccgcaccaatcacgcaggaactccctggccgtagccgtggatccttcgacactcgtgttacgctgcaggagaagtcactggagcttccagctctgccaaccaccaccattggttctttcccacagaccccatccattcgttctgctcgcgctcgtctgcgcaaggaatccatcactttggagcagtacgaagaggcaatgcgcgaagaaatcgatctggtcatcgccaagcaggaagaacttggtcttgatgtgttggttcacggtgagccagagcgcaacgacatggttcagtacttctctgaacttctcgacggtttcctctcaaccgccaacggctgggtccaaagctacggctcccgctgtgttcgtcctccagtgttgttcggaaacgtttcccgcccagcgccaatgactgtcaagtggttccagtacgcacagagcctgacccagaagcatgtcaagggaatgctcaccggtccagtcaccatccttgcatggtccttcgttcgcgatgatcagccgctggctaccactgctgaccaggttgcactggcactgcgcgatgaaattaacgatctcatcgaggctggcgcgaagatcatccaggtggatgagcctgcgattcgtgaactgttgcccgctacgagacgtcgataagcctgcctacctgcagtggt

SEQ ID NO: 228 - protein, 600 aa, Corynebacterium glutamicum
MTSNFSSTVAGLPRIGAKRELKFALEGYWNGSIEGRELAQTARQLVNTASDSLSGLDSVPFAGRSYYDAMLDTAAILGVLPERFDDIADHENDGLPLWIDRYFGAARGTETLPAQAMTKWFDTNYHYLVPELSADTRFVLDASALIEDLRCQQVRGVNARPVLVGPLTFLSLARTTDGSNPLDHLPALFEVYERLIKSFDTEWVQIDEPALVTDVAPEVLEQVRAGYTTLAKRDGVFVNTYFGSGDQALNTLAGIGLGAIGVDLVTHGVTELAAWKGEELLVAGIVDGRNIWRTDLCAALASLKRLAARGPIAVSTSCSLLHVPYTLEAENIEPEVRDWLAFGSEKITEVKLLADALAGNIDAAAFDAASAAIASRRTSPRTAPITQELPGRSRGSFDTRVTLQEKSLELPALPTTTIGSFPQTPSIRSARARLRKESITLEQYEEAMREEIDLVIAKQEELGLDVLVHGEPERNDMVQYFSELLDGFLSTANGWVQSYGSRCVRPPVLFGNVSRPAPMTVKWFQYAQSLTQKHVKGMLTGPVTILAWSFVRDDQPLATTADQVALALRDEINDLIEAGAKIIQVDEPAIRELLPATRRR

SEQ ID NO: 229 - DNA, 603 bp, Corynebacterium glutamicum
  CDS (101)..(580): FRXA02086
gatgatcagccgctggctaccactgctgaccaggttgcactggcactgcgcgatgaaattaacgatctcatcgaggctggcgcgaagatcatccaggtggatgagcctgcgattcgtgaactgttgcccgctacgagacgtcgataagcctgcctacctgcagtggtccgtggactccttccgcctggcgactgccggcgcacccgacgacgtccaaatccacacccacatgtgctactccgagttcaacgaagtgatctcctcggtcatcgcgttggatgccgatgtcaccaccatcgaagcagcacgttccgacatgcaggtcctcgctgctctgaaatcttccggcttcgagctcggcgtcggacctggtgtgtgggatatccactccccgcgcgttccttccgcgcagaaagtggacggtctcctcgaggctgcactgcagtccgtggatcctcgccagctgtgggtcaacccagactgtggtctgaagacccgtggatggccagaagtggaagcttccctaaaggttctcgttgagtccgctaagcaggctcgtgagaaaatcggagcaactatctaaattgggttaccgctaggaac

SEQ ID NO: 230 - protein, 160 aa, Corynebacterium glutamicum
MSLRFVNCCPLRDVDKPAYLQWSVDSFRLATAGAPDDVQIHTHMCYSEFNEVISSVIALDADVTTIEAARSDMQVLAALKSSGFELGVGPGVWDIHSPRVPSAQKVDGLLEAALQSVDPRQLWVNPDCGLKTRGWPEVEASLKVLVESAKQAREKIGATI

SEQ ID NO: 231 - DNA, 1326 bp, Corynebacterium glutamicum
  CDS (101)..(1303): RXN02648
atgaataaaattccgggtgcagtgaccgtaggtgaggtaaacgcggttagagtcgaatgagagtttgatactttctttcgacttttagattggattttcaatgagccagaaccgcatcaggaccactcacgttggttccttgccccgtaccccagagctacttgatgcaaacatcaagcgttctaacggtgagattggggaggaggaattcttccagattctgcagtcttctgtagatgacgtgatcaagcgccaggttgacctgggtatcgacatccttaacgagggcgaatacggccacgtcacctccggtgcagttgacttcggtgcatggtggaactactccttcacccgcctgggcggactgaccatgaccgataccgaccgttgggcaagccaggaagcagtgcgttccacccctggcaacatcgagctgaccagcttctctgatcgtcgcgaccgcgcattgttcagcgaagcatacgaggatccagtatctggcatcttcaccggtcgcgcttctgtgggcaacccagagttcaccggacctattacctacattggccaggaagaaactcagacggatgttgatctgctgaagaagggcatgaacgcagcgggagctaccgacggcttcgttgcagcactatccccaggatctgcagctcgattgaccaacaagttctacgacactgatgaagaagtcgtcgcagcatgtgctgatgcgctttcccaggaatacaagatcatcaccgatgcaggtctgaccgttcagctcgacgcaccggacttggcagaagcatgggatcagatcaacccagagccaagcgtgaaggattacttggactggatcggtacacgcatcgatgccatcaacagtgcagtgaagggccttccaaaggaacagacccgcctgcacatctgctggggctcttggcacggaccacacgtcactgacatcccattcggtgacatcattggtgagatcctgcgcgcagaggtcggtggcttctccttcgaaggcgcatctcctcgtcacgcacacgagtggcgtgtatgggaagaaaacaagcttcctgaaggctctgttatctaccctggtgttgtgtctcactccatcaacgctgtggagcacccacgcctggttgctgatcgtatcgttcagttcgccaagcttgttggccctgagaacgtcattgcgtccactgactgtggtctgggcggacgtctgcattcccagatcgcatgggcaaagctggagtccctagtagagggcgctcgcattgcatcaaaggaactgttctaagctagacaacgagggttgct

SEQ ID NO: 232 - protein, 401 aa, Corynebacterium glutamicum
MSQNRIRTTHVGSLPRTPELLDANIKRSNGEIGEEEFFQILQSSVDDVIKRQVDLGIDILNEGEYGHVTSGAVDFGAWWNYSFTRLGGLTMTDTDRWASQEAVRSTPGNIELTSFSDRRDRALFSEAYEDPVSGIFTGRASVGNPEFTGPITYIGQEETQTDVDLLKKGMNAAGATDGFVAALSPGSAARLTNKFYDTDEEVVAACADALSQEYKIITDAGLTVQLDAPDLAEAWDQINPEPSVKDYLDWIGTRIDAINSAVKGLPKEQTRLHICWGSWHGPHVTDIPFGDIIGEILRAEVGGFSFEGASPRHAHEWRVWEENKLPEGSVIYPGVVSHSINAVEHPRLVADRIVQFAKLVGPENVIASTDCGLGGRLHSQIAWAKLESLVEGARIASKELF

SEQ ID NO: 233 - DNA, 548 bp, Corynebacterium glutamicum
  CDS (1)..(525): FRXA02648
gacgcaccggacttggcagaagcatgggatcagatcaacccagagccaagcgtgaaggattacttggactggatcggtacacgcatcgatgccatcaacagtgcagtgaagggccttccaaaggaacagacccgcctgcacatctgctggggctcttggcacggaccacacgtcactgacatcccattcggtgacatcattggtgagatcctgcgcgcagaggtcggtggcttctccttcgaaggcgcatctcctcgtcacgcacacgagtggcgtgtatgggaagaaaacaagcttcctgaaggctctgttatctaccctggtgttgtgtctcactccatcaacgctgtggagcacccacgcctggttgctgatcgtatcgttcagttcgccaagcttgttggccctgagaacgtcattgcgtccactgactgtggtctgggcggacgtctgcattcccagatcgcatgggcaaagctggagtccctagtagagggcgctcgcattgcatcaaaggaactgttctaagctagacaacgagggttgct

SEQ ID NO: 234 - protein, 175 aa, Corynebacterium glutamicum
DAPDLAEAWDQINPEPSVKDYLDWIGTRIDAINSAVKGLPKEQTRLHICWGSWHGPHVTDIPFGDIIGEILRAEVGGFSFEGASPRHAHEWRVWEENKLPEGSVIYPGVVSHSINAVEHPRLVADRIVQFAKLVGPENVIASTDCGLGGRLHSQIAWAKLESLVEGARIASKELF

SEQ ID NO: 235 - DNA, 784 bp, Corynebacterium glutamicum
  CDS (101)..(784): FRXA02658
atgaataaaattccgggtgcagtgaccgtaggtgaggtaaacgcggttagagtcgaatgagagtttgatactttctttcgacttttagattggattttcaatgagccagaaccgcatcaggaccactcacgttggttccttgccccgtaccccagagctacttgatgcaaacatcaagcgttctaacggtgagattggggaggaggaattcttccagattctgcagtcttctgtagatgacgtgatcaagcgccaggttgacctgggtatcgacatccttaacgagggcgaatacggccacgtcacctccggtgcagttgacttcggtgcatggtggaactactccttcacccgcctgggcggactgaccatgaccgataccgaccgttgggcaagccaggaagcagtgcgttccacccctggcaacatcgagctgaccagcttctctgatcgtcgcgaccgcgcattgttcagcgaagcatacgaggatccagtatctggcatcttcaccggtcgcgcttctgtgggcaacccagagttcaccggacctattacctacattggccaggaagaaactcagacggatgttgatctgctgaagaagggcatgaacgcagcgggagctaccgacggcttcgttgcagcactatccccaggatctgcagctcgattgaccaacaagttctacgacactgatgaagaagtcgtcgcagcatgtgctgatgcgctttcccaggaatacaagatcatcaccgatgcaggtctgaccgttcagctcgacgca

SEQ ID NO: 236 - protein, 228 aa, Corynebacterium glutamicum
MSQNRIRTTHVGSLPRTPELLDANIKRSNGEIGEEEFFQILQSSVDDVIKRQVDLGIDILNEGEYGHVTSGAVDFGAWWNYSFTRLGGLTMTDTDRWASQEAVRSTPGNIELTSFSDRRDRALFSEAYEDPVSGIFTGRASVGNPEFTGPITYIGQEETQTDVDLLKKGMNAAGATDGFVAALSPGSAARLTNKFYDTDEEVVAACADALSQEYKIITDAGLTVQLDA

SEQ ID NO: 237 - DNA, 408 bp, Corynebacterium glutamicum
  CDS (101)..(385): RXC02238
ggcgcttagccaaaacatagagcggtagggtatgcttatccgattgagcaacctttcccgctcttaacactactgtccatatacttttgaaaaggtgtcagtgaccaacgtgagcaacgagaccaacgccaccaaggccgtcttcgatccgccagtgggcattaccgctcctccgatcgatgaactgctggataaggtcacttccaagtacgccctcgtgatcttcgcagccaagcgtgcgcgccagatcaacagcttctaccatcaggcagatgagggagtattcgagttcatcggaccattggttactccgcagccaggcgaaaagccactttctattgctctgcgtgagatcaatgcaggtctgttggaccacgaggaaggttaaaagaccttataacttcacac

SEQ ID NO: 238 - protein, 95 aa, Corynebacterium glutamicum
VTNVSNETNATKAVFDPPVGITAPPIDELLDKVTSKYALVIFAAKRARQINSFYHQADEGVFEFIGPLVTPQPGEKPLSIALREINAGLLDHEEG

SEQ ID NO: 239 - DNA, 1827 bp, Corynebacterium glutamicum
  CDS (101)..(1804): RXC00128
ccattttccgtttggtcttgcctaaagaaccgcatggaaattatcgtgaagcaccgatcccgttgatcgctccagagacaccgtgggaaggggagcagcagtgagtaaaatttcgacgaaactgaaggccctcaccgcggtgctgtctgtgaccactctggtggctgggtgttccacgcttccgcagaacacggatccgcaagtgctgcgctcattttccgggtcccaaagcacacaagagatagcagggccgaccccgaatcaagatccggatttgttgatccgcggcttcttcagcgcaggtgcgtatccgactcagcagtatgaagcggcgaaggcgtatctgacggaagggacgcgcagcacgtggaatccggctgcgtcgactcgtattttggatcgcattgatctgaacactctgccaggttcgacgaatgcggaacgaacgattgcgatccgtggaacgcaggtcggaacgttgctcagcggtggcgtgtatcagccggagaatgcggagtttgaagctgagatcacgatgcgtcgggaagatggggagtggcgtatcgatgctttgccggacgggattttattagagagaaacgatctgcggaaccattacactccgcacgatgtgtatttctttgatccttctggccaggtgttggtgggggatcggcgttggttgttcaatgagtcgcagtcgatgtccacggtgctgatggcccttctggttaatggtccttcgccggcaatttctcctggtgtggtcaatcagctgtccacggatgcgtcgttcgtggggttcaatgatggggagtatcagttcactggtttgggaaatttggatgatgatgcgcgtttgcgtttcgccgcccaggccgtgtggacgttggcgcatgctgatgtcgcaggcccctacactttggtcgctgacggcgcgccgttgctgtcggagttcccaacgctcaccaccgatgacctcgccgaatacaacccagaggcttacaccaacacggtgtccacgttgtttgcgttgcaggatggatcgttgtcgagggtcagttccggcaatgtgagtccactacagggcatttggagcggtggagatatcgattctgcagcgatttcctcctccgccaatgtggtggcagcggtacgccacgaaaacaacgaggcagtgcttactgttggctccatggaaggcgtgacttcagatgcgttgaggagtgaaacgatcactcgtcccacctttgaatacgcgtcgagtgggttgtgggctgtggtggatggggagacgcctgtccgagtcgcacgatcggcaacaaccggtgagctcgtccagacggaggcggagattgtgctgccaagggatgtgacgggtccgatctctgaattccaactgtcacgaactggggtccgggccgccatgatcattgaaggcaaggtgtacgtgggcgtcgtaacgcgtcctggtccgggcgagcggcgcgtgacaaatatcacggaggtggcgccgagcttgggcgaggcggcgctgtcgatcaactggcgcccagacggcattttgcttgtgggcacgtcaattccagagacgccgctgtggcgcgtcgagcaggacggatcggcgatttcgtcgatgccgagcgggaatctcagcgcgccggtggtggcggtggcaagttccgcgacgacggtctacgtcactgattcgcatgcgatgcttcagctgccgactgccgataatgatatttggcgcgaggtgcccggtttgctgggcacgcgtgcggcgccggtggttgcgtactgatggagctgttcttcccgcgc

SEQ ID NO: 240 - protein, 568 aa, Corynebacterium glutamicum
VSKISTKLKALTAVLSVTTLVAGCSTLPQNTDPQVLRSFSGSQSTQEIAGPTPNQDPDLLIRGFFSAGAYPTQQYEAAKAYLTEGTRSTWNPAASTRILDRIDLNTLPGSTNAERTIAIRGTQVGTLLSGGVYQPENAEFEAEITMRREDGEWRIDALPDGILLERNDLRNHYTPHDVYFFDPSGQVLVGDRRWLFNESQSMSTVLMALLVNGPSPAISPGVVNQLSTDASFVGFNDGEYQFTGLGNLDDDARLRFAAQAVWTLAHADVAGPYTLVADGAPLLSEFPTLTTDDLAEYNPEAYTNTVSTLFALQDGSLSRVSSGNVSPLQGIWSGGDIDSAAISSSANVVAAVRHENNEAVLTVGSMEGVTSDALRSETITRPTFEYASSGLWAVVDGETPVRVARSATTGELVQTEAEIVLPRDVTGPISEFQLSRTGVRAAMIIEGKVYVGVVTRPGPGERRVTNITEVAPSLGEAALSINWRPDGILLVGTSIPETPLWRVEQDGSAISSMPSGNLSAPVVAVASSATTVYVTDSHAMLQLPTADNDIWREVPGLLGTRAAPVVAY

SEQ ID NO: 241 - DNA, 1344 bp, Corynebacterium glutamicum
  CDS (101)..(1321): RXA02240
cagctagaccactgacattgcagttttagacagcttggtctatattggttttttgtatttaagactatttattctcaacttcttcgaaagaagggtatttgtggctcagccaaccgccgtccgtttgttcaccagtgaatctgtaactgagggacatccagacaaaatatgtgatgctatttccgataccattttggacgcgctgctcgaaaaagatccgcagtcgcgcgtcgcagtggaaactgtggtcaccaccggaatcgtccatgttgttggcgaggtccgtaccagcgcttacgtagagatccctcaattagtccgcaacaagctcatcgaaatcggattcaactcctctgaggttggattcgacggacgcacctgtggcgtctcagtatccatcggtgagcagtcccaggaaatcgctgacggcgtggataactccgacgaagcccgcaccaacggcgacgttgaagaagacgaccgcgcaggtgctggcgaccagggcctgatgttcggctacgccaccaacgaaaccgaagagtacatgcctcttcctatcgcgttggcgcaccgactgtcacgtcgtctgacccaggttcgtaaagagggcatcgttcctcacctgcgtccagacggaaaaacccaggtcaccttcgcatacgatgcgcaagaccgccctagccacctggataccgttgtcatctccacccagcacgacccagaagttgaccgtgcatggttggaaacccaactgcgcgaacacgtcattgattgggtaatcaaagacgcaggcattgaggatctggcaaccggtgagatcaccgtgttgatcaacccttcaggttccttcattctgggtggccccatgggtgatgcgggtctgaccggccgcaagatcatcgtggatacctacggtggcatggctcgccatggtggtggagcattctccggtaaggatccaagcaaggtggaccgctctgctgcatacgccatgcgttgggtagcaaagaacatcgtggcagcaggccttgctgatcgcgctgaagttcaggttgcatacgccattggacgcgcaaagccagtcggactttacgttgaaacctttgacaccaacaaggaaggcctgagcgacgagcagattcaggctgccgtgttggaggtctttgacctgcgtccagcagcaattatccgtgagcttgatctgcttcgtccgatctacgctgacactgctgcctacggccactttggtcgcactgatttggaccttccttgggaggctatcgaccgcgttgatgaacttcgcgcagccctcaagttggcctaaaaatctgatgtagtatcttc

SEQ ID NO: 242 - protein, 407 aa, Corynebacterium glutamicum
VAQPTAVRLFTSESVTEGHPDKICDAISDTILDALLEKDPQSRVAVETVVTTGIVHVVGEVRTSAYVEIPQLVRNKLIEIGFNSSEVGFDGRTCGVSVSIGEQSQEIADGVDNSDEARTNGDVEEDDRAGAGDQGLMFGYATNETEEYMPLPIALAHRLSRRLTQVRKEGIVPHLRPDGKTQVTFAYDAQDRPSHLDTVVISTQHDPEVDRAWLETQLREHVIDWVIKDAGIEDLATGEITVLINPSGSFILGGPMGDAGLTGRKIIVDTYGGMARHGGGAFSGKDPSKVDRSAAYAMRWVAKNIVAAGLADRAEVQVAYAIGRAKPVGLYVETFDTNKEGLSDEQIQAAVLEVFDLRPAAIIRELDLLRPIYADTAAYGHFGRTDLDLPWEAIDRVDELRAALKLA

SEQ ID NO: 243 - DNA, 669 bp, Corynebacterium glutamicum
  CDS (101)..(646): RXA00780
ccttttaagtccttctttgcccgtgaataattctctggatagtttccacgtgcagttaagtcacgctgttagacttgcctgcatgctctcgacaataaaaatgatccgtgaagatctcgcaaacgctcgtgaacacgatccagcagcccgaggcgatttagaaaacgcagtggtttactccggactccacgccatctgggcacatcgagttgccaacagctggtggaaatccggtttccgcggccccgcccgcgtattagcccaattcacccgattcctcaccggcattgaaattcaccccggtgccaccattggtcgtcgcttttttattgaccacggaatgggaatcgtcatcggcgaaaccgctgaaatcggcgaaggcgtcatgctctaccacggcgtcaccctcggcggacaggttctcacccaaaccaagcgccaccccacgctctgcgacaacgtgacagtcggcgcgggcgcaaaaatcttaggtcccatcaccatcggcgaaggctccgcaattggcgccaatgcagttgtcaccaaagacgtgccggcagaacacatcgcagtcggaattcctgcggtagcacgcccacgtggcaagacagagaagatcaagctcgtcgatccggactattacatttaagaacagttagcgccctacct

SEQ ID NO: 244 - protein, 182 aa, Corynebacterium glutamicum
MIREDLANAREHDPAARGDLENAVVYSGLHAIWAHRVANSWWKSGFRGPARVLAQFTRFLTGIEIHPGATIGRRFFIDHGMGIVIGETAEIGEGVMLYHGVTLGGQVLTQTKRHPTLCDNVTVGAGAKILGPITIGEGSAIGANAVVTKDVPAEHIAVGIPAVARPRGKTEKIKLVDPDYYI

SEQ ID NO: 245 - DNA, 1056 bp, Corynebacterium glutamicum
  CDS (101)..(1033): RXA00779
cagaggccacttcaagtagatgtttcgtaattgtttacagcgtttacgcaagcggtcgaccaacaaaaacagcacttcaatgattggagcaccacccgacatgggcaatgtgtacaacaacatcaccgaaaccatcggccacaccccactggtaaagctgaacaagctcaccgaaggcctcgacgcaactgtcctggtcaagcttgagtcattcaacccagcaaactccgtcaaggaccgtatcggtctggccatcgttgaagatgcagagaagtccggtgcactgaagccaggcggcaccatcgttgaagcaacctccggcaacaccggtatcgcactggcaatggtcggcgctgcacgcggatacaacgttgttctcaccatgccggagaccatgtccaacgagcgtcgcgttctcctccgcgcttacggtgcagagatcgttcttaccccaggtgcagcaggcatgcagggtgcaaaggacaaggcagacgaaatcgtcgctgaacgcgaaaacgcagtccttgctcgccagttcgagaacgaggcaaacccacgcgtcaaccgcgacaccaccgcgaaggaaatcctcgaagacaccgacggcaccgttgatatcttcgttgcaagcttcggcaccggcggaaccgtcaccggcgttggccaggtcctgaaggaaaacaacgcagacgtacaggtctacaccgtcgagccagaagcgtccccacttctgaccgctggcaaggctggtccacacaagatccagggcatcggcgcaaacttcatccccgaggtcctggaccgcaaggttctcgacgacgtgctgaccgtctccaacgaagacgcaatcgcattctcccgcaagctcgctaccgaagagggcatcctcggcggtatctccaccggcgcaaacatcaaggcagctcttgaccttgcagcaaagccagagaacgctggcaaaaccatcgtcaccgttgtcaccgacttcggcgagcgctacgtctccaccgttctttacgaagacatccgcgactaattcttagcgactgttaacca

SEQ ID NO: 246 - protein, 311 aa, Corynebacterium glutamicum
MGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVNRDTTAKEILEDTDGTVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 247 - DNA, 623 bp, Corynebacterium glutamicum; identical to SEQ ID NO: 203
  CDS (1)..(600): RXN00402

SEQ ID NO: 248 - protein, 200 aa, Corynebacterium glutamicum; identical to SEQ ID NO: 204

SEQ ID NO: 249 - DNA, 599 bp, Corynebacterium glutamicum; identical to SEQ ID NO: 205
  CDS (1)..(576): FRXA00402

SEQ ID NO: 250 - protein, 192 aa, Corynebacterium glutamicum; identical to SEQ ID NO: 206

SEQ ID NO: 251 - DNA, 613 bp, Corynebacterium glutamicum; identical to SEQ ID NO: 207
  CDS (101)..(613): RXS00405

SEQ ID NO: 252 - protein, 171 aa, Corynebacterium glutamicum; identical to SEQ ID NO: 208

SEQ ID NO: 253 - DNA, 1812 bp, Corynebacterium glutamicum
  CDS (101)..(1789): RXC00164
ctgctttgcgggaggttatgaaatgagtggggagacgtcgaaaagcatgcgctttccgttggccagcctgccgcaagtgcggcgcgaggtggcccggcaggtgggtcgtattccgcgggcgaagtggtggtttttaggcgcgctggtgttgctgagtgcgggcgcttatgcgtcggtgctggtgccgcaggtgctggggcggattgtggatctggtgtccgatggcgcgcagatgcgtgattttgttgagctcagtgtgattctcattgcggtggcaattgccggcgcggtgctcagtgcgtgcgggttctatgtggtgtcgcggatttctgagaagattatcgccaatttgagggaagatatggtgggcaccgcgcttgggttgcccacgcaccaggtggaagatgcgggctctggcgatttggtgagccgctccaccgatgatgtctccgagctatccgcagcggtgacagagaccgtcccgattttaagttcctcactgtttaccattgccgcgacgatcattgcgctgttttctttggactggcaatttgtgctcattcctgtcgtggtggcgccggtgtactacttcgcgtccaagcactatttgagcaaggcgccggatcggtatgcggcagaacgcgcggcgatggcggagcgtgcgcgaaaggtacttgaggctattcgcgggcgtgcaactgtgcgggcgtattccatggaagatgccatgcataatcagattgatcaggcgtcgtggtctgtggtggtcaagggtattcgtgcgcgcaccaccatgttgattttgaacatgtggatgctgtttgcggaattcctcatgctcgcggtcgcgttggtgatcggctacaagctggtcattgataatgcgctgacgatcggcgcggttaccggtgccgtgctgatgattattcgtctgcgtggcccgatgaatatgttcatgcgcgtgctcgacaccattcaatccggctatgcgtcgctggcgcgcatcgtgggagttgttgcggatccgccgattcctgtgcccgacagcggtgtgaaagcacctcagggcaaagtggaattgcgcaacgtcagctttagctatggcgattcctgggcggtgaaagacatcgacatcacgatcaattccggcgaaactgtcgcgctcgtgggcgcatctggcgcaggtaagacgacggtcgccgccttgctggcgggcttgcgggtgccagatcaagggcaagtgcttgtcgacgacttccccgtctctcacctctctgaccgcgagcgtatcgcccgcttggccatggtcagccaggaggttcatgttttctccggcacgctgcgccaggatctcaccttggctaaaccagatgcctccgatgaggaattagcgcatgctcttgggcaagttaatgcccttgactggttggagagtcttccagaaggactggacacggtcgttggtgcgcgaggaatccagctagaaccagtggtggctcagcagttggcgttggcccgggtgttgttgctcaatccggcgatcgtcatcatggatgaagccacggcagaagcaggatcggcgggtgccagcgcactggaagaggctgcagatgcagtgagcaagaaccgttccgcattggtggtggcgcaccggttggatcaggcatcgcgggctgatcagattctggtgatggataagggggaggttgtggaatccggtactcaccaggagttattggatcacgggggtatttatcagcgtctgtggactgcgtggagtgtcggaagatagttgactgttcaatgcgttga

SEQ ID NO: 254 - protein, 563 aa, Corynebacterium glutamicum
VGRIPRAKWWFLGALVLLSAGAYASVLVPQVLGRIVDLVSDGAQMRDFVELSVILIAVAIAGAVLSACGFYVVSRISEKIIANLREDMVGTALGLPTHQVEDAGSGDLVSRSTDDVSELSAAVTETVPILSSSLFTIAATIIALFSLDWQFVLIPVVVAPVYYFASKHYLSKAPDRYAAERAAMAERARKVLEAIRGRATVRAYSMEDAMHNQIDQASWSVVVKGIRARTTMLILNMWMLFAEFLMLAVALVIGYKLVIDNALTIGAVTGAVLMIIRLRGPMNMFMRVLDTIQSGYASLARIVGVVADPPIPVPDSGVKAPQGKVELRNVSFSYGDSWAVKDIDITINSGETVALVGASGAGKTTVAALLAGLRVPDQGQVLVDDFPVSHLSDRERIARLAMVSQEVHVFSGTLRQDLTLAKPDASDEELAHALGQVNALDWLESLPEGLDTVVGARGIQLEPVVAQQLALARVLLLNPAIVIMDEATAEAGSAGASALEEAADAVSKNRSALVVAHRLDQASRADQILVMDKGEVVESGTHQELLDHGGIYQRLWTAWSVGR

SEQ ID NO: 255 - DNA, 1713 bp, Corynebacterium glutamicum
  CDS (101)..(1690): RXC01191
cgctgctttcacgcaactgaaaccgcaccggatcaagttatttggggttgttctttgtggcgtgttggtggccgtcgcggggttggtagggccctgggcggtgggtggactcgtcgataagctccttgcaaccccgagcatgcgcgacgttgtagtgttcgcgctgcttatcgtggctggcggcgttgtttcgagcctgggcacgtggtggggcagcgcgctgatggcgcgcgcgttggagccggcgatcgcggggctgcgcgaggatgtgttgcgcgcggcggtgagtttggatgcgaacacgattgaaacggcggggcgcggcgacgtgatttcgcgtatcgcggatgattcgcgggaggtgtccactgcggcgagcaccgtggtgccgctgatggtgcaggcgggctttaccgtggtgatttccgcgtttggcatggcggcggttgattggcgcctcggccttgtcggtttggtcgcgatcccgctgtattggaccacgttgcgcgtctatttaccccgctcaggtccgctttatacgcgtgagcgcgaggcctttggggtgcgcacgcagcggcttgtcggcgcagtcgaaggcgcggaaaccttgcgcgctttccgcgcagaagatacagaattaaagcgtatcgacgcagcctccggcgaagcccgcgacatttccatttctgttttcaggttcctcacatgggcattttcccgcaacaaccgcgcggaatgcatcaccctcgtgctcatcttgggcaccggcttttacctggtcaacatcgatctggtcaccgtcggcgcagtctcaaccgccgcactgatcttccaccgactcttcggtccaatcggcacgctcgtgggcatgttctccgacatccaatccgccagcgcatcgctgatccgcatggtgggcgttattaacgcggcatcgaaccaggtcagcggcacctcgccggcgtctgccagcaccgctttaacgcttttcgacgtctcccaccactatcacactgcacccgtcatcaagaatgcatccgtgcagctggaaccaggggaacacatcgccattgtgggtgcgaccggcgctggtaaaagcacgctcgccctcattgcggcaggcctgctcagcccaacttccgggcaggtggctctcggcggatcgagtttttctaacgtcgaaccggaagcattgcgccagaagatcgcgatggtcagccaagaaatccactgcttccgaggatctgttttagataatcttcgtatcgcacgccccgaagccaccgatgcggacatccacgccgttctcgccgatattggtgattcctggttggagcgcttaccgcaaggcatagacaccatcgtgggtgatggcgctttccgtttaacctctgtggaaaaccagatcatggcgcttgctcgcgtacatttggccgacctagcaatcgtcatccttgatgaagcaacggctgaatcaggctctgatcatgcaaaacagcttgaagatgcagcccttaaagtcactgaaaacagatcagccatcatcgtggctcaccgcctcaaccaagcgaaaaccgccgatcgcatcatcgtcatggactccggagaaatcatagaatctggaacccatgaagagcttcgagcgatcggcggccgatatgaacaactgtggactgcgtggtctgcgcgctaattagccacccaagaccacgc

SEQ ID NO: 256 - protein, 530 aa, Corynebacterium glutamicum
VGGLVDKLLATPSMRDVVVFALLIVAGGVVSSLGTWWGSALMARALEPAIAGLREDVLRAAVSLDANTIETAGRGDVISRIADDSREVSTAASTVVPLMVQAGFTVVISAFGMAAVDWRLGLVGLVAIPLYWTTLRVYLPRSGPLYTREREAFGVRTQRLVGAVEGAETLRAFRAEDTELKRIDAASGEARDISISVFRFLTWAFSRNNRAECITLVLILGTGFYLVNIDLVTVGAVSTAALIFHRLFGPIGTLVGMFSDIQSASASLIRMVGVINAASNQVSGTSPASASTALTLFDVSHHYHTAPVIKNASVQLEPGEHIAIVGATGAGKSTLALIAAGLLSPTSGQVALGGSSFSNVEPEALRQKIAMVSQEIHCFRGSVLDNLRIARPEATDADIHAVLADIGDSWLERLPQGIDTIVGDGAFRLTSVENQIMALARVHLADLAIVILDEATAESGSDHAKQLEDAALKVTENRSAIIVAHRLNQAKTADRIIVMDSGEIIESGTHEELRAIGGRYEQLWTAWSAR

SEQ ID NO: 257 - DNA, 1392 bp, Corynebacterium glutamicum
  CDS (101)..(1369): RXA02646
ttggaaataaaacctatgccaaagtaggtgcaattctaggagaagattacactagtcaaccatgagtgaaacatacgtgtctgagaaaagtccaggagtgatggctagcggagcggagctgattcgtgccgccgacattcaaacggcgcaggcacgaatttcctccgtcattgcaccaactccattgcagtattgccctcgtctttctgaggaaaccggagcggaaatctaccttaagcgtgaggatctgcaggatgttcgttcctacaagatccgcggtgcgctgaactctggagcgcagctcacccaagagcagcgcgatgcaggtatcgttgccgcatctgcaggtaaccatgcccagggcgtggcctatgtgtgcaagtccttgggcgttcagggacgcatctatgttcctgtgcagactccaaagcaaaagcgtgaccgcatcatggttcacggcggagagtttgtctccttggtggtcactggcaataacttcgacgaagcatcggctgcagcgcatgaagatgcagagcgcaccggcgcaacgctgatcgagcctttcgatgctcgcaacaccgtcatcggtcagggcaccgtggctgctgagatcttgtcgcagctgacttccatgggcaagagtgcagatcacgtgatggttccagtcggcggtggcggacttcttgcaggtgtggtcagctacatggctgatatggcacctcgcactgcgatcgttggtatcgaaccagcgggagcagcatccatgcaggctgcattgcacaatggtggaccaatcactttggagactgttgatccctttgtggacggcgcagcagtcaaacgtgtcggagatctcaactacaccatcgtggagaagaaccagggtcgcgtgcacatgatgagcgcgaccgagggcgctgtgtgtactgagatgctcgatctttaccaaaacgaaggcatcatcgcggagcctgctggcgcgctgtctatcgctgggttgaaggaaatgtcctttgcagctcgctctgtcgtggtgtgcatcatctctggtggcaacaacgatgtgctgcgttatgcggaaatcgctgagcgctccttggtgcgccgcggtttaaagcactacttcttggtgaacttcccgcaaaagcctggtcagttgcgtcacttcctggaagatatcctgggaccggatgatgacatcacgctgtttgagtacctcaagcgcaacaaccgtgagaccggtactgcgttggtgggtattcacttgagtgaagcatcaggattggattctttgctggaacgtatggaggaatcggcaattgattcccgtcgcctcgagccgggcacccctgagtacgaatacttgacctaaacatagctgaaggccacctc

SEQ ID NO: 258 - protein, 423 aa, Corynebacterium glutamicum
MASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAARSVVVCIISGGNNDVLRYAEIAERSLVRRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 259 - DNA, 966 bp, Corynebacterium glutamicum
  CDS (101)..(943): RXA00766
tatggcgcttgaaccacaaataaagtctgcaccgacgccggtgatcttaattgtcgaaccctacggcgggtccatccggcaacaaaaccccaacctaccaatggttttttgggacgatgcagccttaacccgaggcgatggcatctttgaaacactcctcatccgcgacggacatgcctgcaacgtgcgccgacacggagaacgcttcaaagcatcggcagcactattgggactgccagagccgatcctggaagactgggaaaaagccacccaaatgggcatcgaatcctggtactcccaccccaacgcaggcgaggcctcatgcacctggacgctcagccgaggtcgttcctccacggggctggcctcaggatggttaaccatcaccccagtctcctccgacaaactggcgcaacgtgaacacggtgtatcggtcatgaccagttcaagaggatattccatcgacaccggcctccccggaatcggaaaagccacccgaggcgagctatctaaagtggaacgaacccccgcaccatggctgacagtcggcgccaaaacactagcctacgcagcaaacatggcagccctgcgctacgccaaatcaaacggattcgacgatgtgatcttcaccgatggcgaccgcgttctagaaggcgccacctccaccgtagtgagtttcaaaggcgacaaaatccgcaccccttcacccggtggcgacattctccccggaaccacccaagcagcactctttgcacacgcaaccgaaaaaggatggcgatgtaaagaaaaagacttaagcattgacgatcttttcggagccgacagcgtgtggctagtgtcctccgtccgcggaccagttcgggtgaccaggctcgatggacacaaattacggaaaccagacaatgaaaaagaaatcaaggcgctgattaccaaagctctggggtagaggctggcgctgggacttgc

SEQ ID NO: 260 - protein, 281 aa, Corynebacterium glutamicum
MVFWDDAALTRGDGIFETLLIRDGHACNVRRHGERFKASAALLGLPEPILEDWEKATQMGIESWYSHPNAGEASCTWTLSRGRSSTGLASGWLTITPVSSDKLAQREHGVSVMTSSRGYSIDTGLPGIGKATRGELSKVERTPAPWLTVGAKTLAYAANMAALRYAKSNGFDDVIFTDGDRVLEGATSTVVSFKGDKIRTPSPGGDILPGTTQAALFAHATEKGWRCKEKDLSIDDLFGADSVWLVSSVRGPVRVTRLDGHKLRKPDNEKEIKALITKALG

SEQ ID NO: 261 - DNA, 1224 bp, Corynebacterium glutamicum
  CDS (101)..(1201): RXN01690
cctagccattcctcaaaaccgtgagacgaaattggctattcatcccataaaatggggctgactagtgtatctgtcaggtagcaggtgtaccttaaaatccatgacgtcattagagttcacagtaacccgtaccgaaaatccgacgtcacccgatcgtctgaaggaaattcttgccgcaccgaagttcggtaagttcttcaccgaccacatggtgaccattgactggaacgagtcggaaggctggcacaacgcccaattagtgccatacgcgccgattcctatggatcctgccaccaccgtattccactacggacaggcaatttttgagggaattaaggcctaccgccattcggacgaaaccatcaagactttccgtcctgatgaaaacgccgagcgtatgcagcgttcagcagctcgaatggcaatgccacagttgccaaccgaggactttattaaagcacttgaactgctggtagacgcggatcaggattgggttcctgagtacggcggagaagcttccctctacctgcgcccattcatgatctccaccgaaattggcttgggtgtcagcccagctgatgcctacaagttcctggtcatcgcatccccagtcggcgcttacttcaccggtggaatcaagcctgtttccgtctggctgagcgaagattacgtccgcgctgcacccggcggaactggtgacgccaaatttgctggcaactacgcggcttctttgcttgcccagtcccaggctgcggaaaagggctgtgaccaggtcgtatggttggatgccatcgagcacaagtacatcgaagaaatgggtggcatgaaccttgggttcatctaccgcaacggcgaccaagtcaagctagtcacccctgaactttccggctcactacttccaggcatcacccgcaagtcacttctacaagtagcacgcgacttgggatacgaagtagaagagcgaaagatcaccaccaccgagtgggaagaagacgcaaagtctggcgccatgaccgaggcatttgcttgcggtactgcagctgttatcacccctgttggcaccgtgaaatcagctcacggcaccttcgaagtgaacaacaatgaagtcggagaaatcacgatgaagcttcgtgaaaccctcaccggaattcagcaaggaaacgttgaagaccaaaacggatggctttacccactggttggctaaatcaaccggttttaagaccc

SEQ ID NO: 262 - protein, 367 aa, Corynebacterium glutamicum
MTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 263 - DNA, 1076 bp, Corynebacterium glutamicum
  CDS (1)..(1053): FRXA01690
cccgatcgtctgaaggaaattcttgccgcaccgaagttcggtaagttcttcaccgaccacatggtgaccattgactggaacgagtcggaaggctggcacaacgcccaattagtgccatacgcgccgattcctatggatcctgccaccaccgtattccactacggacaggcaatttttgagggaattaaggcctaccgccattcggacgaaaccatcaagactttccgtcctgatgaaaacgccgagcgtatgcagcgttcagcagctcgaatggcaatgccacagttgccaaccgaggactttattaaagcacttgaactgctggtagacgcggatcaggattgggttcctgagtacggcggagaagcttccctctacctgcgcccattcatgatctccaccgaaattggcttgggtgtcagcccagctgatgcctacaagttcctggtcatcgcatccccagtcggcgcttacttcaccggtggaatcaagcctgtttccgtctggctgagcgaagattacgtccgcgctgcacccggcggaactggtgacgccaaatttgctggcaactacgcggcttctttgcttgcccagtcccaggctgcggaaaagggctgtgaccaggtcgtatggttggatgccatcgagcacaagtacatcgaagaaatgggtggcatgaaccttgggttcatctaccgcaacggcgaccaagtcaagctagtcacccctgaactttccggctcactacttccaggcatcacccgcaagtcacttctacaagtagcacgcgacttgggatacgaagtagaagagcgaaagatcaccaccaccgagtgggaagaagacgcaaagtctggcgccatgaccgaggcatttgcttgcggtactgcagctgttatcacccctgttggcaccgtgaaatcagctcacggcaccttcgaagtgaacaacaatgaagtcggagaaatcacgatgaagcttcgtgaaaccctcaccggaattcagcaaggaaacgttgaagaccaaaacggatggctttacccactggttggctaaatcaaccggttttaagaccc

SEQ ID NO: 264 - protein, 351 aa, Corynebacterium glutamicum
PDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 265 - DNA, 1782 bp, Corynebacterium glutamicum
  CDS (101)..(1759): RXN01026
gaggtgacatttatgcctcttaatagctatactgtcccatgaaacgatattttaatctcatatagtgagatttacagatttttaaaggacggtgagttccatgaccagccccgtggagaacagcacctcaactgagaagctgaccctggcagagaaggtgtggcgcgaccatgtcgtgtccaagggagaaaacggcgagcccgacctcctctacatcgacctgcagctgctgcatgaagtgacctcaccacaggcatttgacggcctgcgcatgaccggccgtaaactgcgccacccagaactgcacctggccaccgaagaccacaacgtgccaaccgaaggcatcaagactggctcactgctggaaatcaacgacaagatttcccgcctgcaggtatctactctgcgcgacaactgtgaagaattcggcgtgcgcctgcacccaatgggtgatgtccgacagggcatcgtgcacaccgtcggcccacagctcggcgcaacccagccaggcatgaccattgtgtgcggtgactcccacacctccacccacggtgcttttggctccatggcattcggcatcggtacctcagaggttgagcacgtcatggctactcaaaccctgccactgaagcctttcaagaccatggccattgaagttactggtgaactgcagccaggtgtttcctccaaggacctgattctggcgattatcgccaagatcggcaccggcggcggacagggctacgttctggaataccgcggcgaagcaatccgtaagatgtccatggatgcacgcatgaccatgtgcaacatgtccatcgaagctggcgcacgtgccggcatgatcgccccagaccaaaccaccttcgactacgttgaaggccgcgaaatggcaccaaagggcgccgactgggacgaagcagttgcttactggaagaccctgccaaccgacgaaggcgcaacctttgacaaggtcgtagaaatcgatggctcggcactgaccccattcatcacctggggcaccaacccaggccagggcctgccactgggcgaatccgtaccaagcccagaagacttcaccaacgacaacgacaaggcagcagccgaaaaggcactgcagtacatggacctggtaccaggaaccccactgcgcgacatcaagatcgacaccgtcttcctgggatcctgcaccaacgcccgcatcgaagacctgcagatcgccgctgacatcctcaagggccacaaaatcgccgacggcatgcgcatgatggtcgtgccttcctccacctggatcaagcaagaggcagaagcgctcggactggacaaaatcttcaccgacgctggcgctgaatggcgtaccgcaggctgctccatgtgcctgggcatgaacccagaccaactgaagccaggcgagcgctccgcattcacctccaaccgaaacttcgaaggacgccaaggaccaggaggccgcacccacctggtatccccagcagtcgcagccgccaccgaatccgcggaccctgtcctcacctgcagatatctaaggaaggctagaaaacaatggaaaaatttaccacctacaccggcgttggcgttccactgcagcgatccaacgtggacaccgaccagatcatcccagccgtctacctcaagcgcgtcacccggaccggcttcgaagacggactgttttccaactggcgccaaaacgaccccaactttgtcctcaacaccgacacctacaagaacggctccgttctcgtagcaggccctgactttggcacc

SEQ ID NO: 266 - protein, 553 aa, Corynebacterium glutamicum
MTSPVENSTSTEKLTLAEKVWRDHVVSKGENGEPDLLYIDLQLLHEVTSPQAFDGLRMTGRKLRHPELHLATEDHNVPTEGIKTGSLLEINDKISRLQVSTLRDNCEEFGVRLHPMGDVRQGIVHTVGPQLGATQPGMTIVCGDSHTSTHGAFGSMAFGIGTSEVEHVMATQTLPLKPFKTMAIEVTGELQPGVSSKDLILAIIAKIGTGGGQGYVLEYRGEAIRKMSMDARMTMCNMSIEAGARAGMIAPDQTTFDYVEGREMAPKGADWDEAVAYWKTLPTDEGATFDKVVEIDGSALTPFITWGTNPGQGLPLGESVPSPEDFTNDNDKAAAEKALQYMDLVPGTPLRDIKIDTVFLGSCTNARIEDLQIAADILKGHKIADGMRMMVVPSSTWIKQEAEALGLDKIFTDAGAEWRTAGCSMCLGMNPDQLKPGERSAFTSNRNFEGRQGPGGRTHLVSPAVAAATESADPVLTCRYLRKARKQWKNLPPTPALAFHCSDPTWTPTRSSQPSTSSASPGPASKTDCFPTGAKTTPTLSSTPTPTRTAPFS

SEQ ID NO: 267 - DNA, 1625 bp, Corynebacterium glutamicum
  CDS (1)..(1602): FRXA01026
gtgtggcgcgaccatgtcgtgtccaagggagaaaacggcgagcccgacctcctctacatcgacctgcagctgctgcatgaagtgacctcaccacaggcatttgacggcctgcgcatgaccggccgtaaactgcgccacccagaactgcacctggccaccgaagaccacaacgtgccaaccgaaggcatcaagactggctcactgctggaaatcaacgacaagatttcccgcctgcaggtatctactctgcgcgacaactgtgaagaattcggcgtgcgcctgcacccaatgggtgatgtccgacagggcatcgtgcacaccgtcggcccacagctcggcgcaacccagccaggcatgaccattgtgtgcggtgactcccacacctccacccacggtgcttttggctccatggcattcggcatcggtacctcagaggttgagcacgtcatggctactcaaaccctgccactgaagcctttcaagaccatggccattgaagttactggtgaactgcagccaggtgtttcctccaaggacctgattctggcgattatcgccaagatcggcaccggcggcggacagggctacgttctggaataccgcggcgaagcaatccgtaagatgtccatggatgcacgcatgaccatgtgcaacatgtccatcgaagctggcgcacgtgccggcatgatcgccccagaccaaaccaccttcgactacgttgaaggccgcgaaatggcaccaaagggcgccgactgggacgaagcagttgcttactggaagaccctgccaaccgacgaaggcgcaacctttgacaaggtcgtagaaatcgatggctcggcactgaccccattcatcacctggggcaccaacccaggccagggcctgccactgggcgaatccgtaccaagcccagaagacttcaccaacgacaacgacaaggcagcagccgaaaaggcactgcagtacatggacctggtaccaggaaccccactgcgcgacatcaagatcgacaccgtcttcctgggatcctgcaccaacgcccgcatcgaagacctgcagatcgccgctgacatcctcaagggccacaaaatcgccgacggcatgcgcatgatggtcgtgccttcctccacctggatcaagcaagaggcagaagcgctcggactggacaaaatcttcaccgacgctggcgctgaatggcgtaccgcaggctgctccatgtgcctgggcatgaacccagaccaactgaagccaggcgagcgctccgcattcacctccaaccgaaacttcgaaggacgccaaggaccaggaggccgcacccacctggtatccccagcagtcgcagccgccaccgaatccgcggaccctgtcctcacctgcagatatctaaggaaggctagaaaacaatggaaaaatttaccacctacaccggcgttggcgttccactgcagcgatccaacgtggacaccgaccagatcatcccagccgtctacctcaagcgcgtcacccggaccggcttcgaagacggactgttttccaactggcgccaaaacgaccccaactttgtcctcaacaccgacacctacaagaacggctccgttctcgtagcaggccctgactttggcacc

SEQ ID NO: 268 - protein, 534 aa, Corynebacterium glutamicum
VWRDHVVSKGENGEPDLLYIDLQLLHEVTSPQAFDGLRMTGRKLRHPELHLATEDHNVPTEGIKTGSLLEINDKISRLQVSTLRDNCEEFGVRLHPMGDVRQGIVHTVGPQLGATQPGMTIVCGDSHTSTHGAFGSMAFGIGTSEVEHVMATQTLPLKPFKTMAIEVTGELQPGVSSKDLILAIIAKIGTGGGQGYVLEYRGEAIRKMSMDARMTMCNMSIEAGARAGMIAPDQTTFDYVEGREMAPKGADWDEAVAYWKTLPTDEGATFDKVVEIDGSALTPFITWGTNPGQGLPLGESVPSPEDFTNDNDKAAAEKALQYMDLVPGTPLRDIKIDTVFLGSCTNARIEDLQIAADILKGHKIADGMRMMVVPSSTWIKQEAEALGLDKIFTDAGAEWRTAGCSMCLGMNPDQLKPGERSAFTSNRNFEGRQGPGGRTHLVSPAVAAATESADPVLTCRYLRKARKQWKNLPPTPALAFHCSDPTWTPTRSSQPSTSSASPGPASKTDCFPTGAKTTPTLSSTPTPTRTAPFS

SEQ ID NO: 269 - DNA, 1143 bp, Corynebacterium glutamicum
  CDS (101)..(1120): RXN01127
gccctgcatgatggggtagtgggggttgttgggcaggtacgagctgtgatcaatcagctacactagtgaagtccatatagtgagaagggaatcccacaacatgaaacttgctgttattggtggagatggtatcggcccagaggttactgcagaagccctcaaggttctaaacgctgtccgcgacgacatcgagaccaccgattatgaccttggcgcacgccgttacctcaaaaatggcgagctgctcaccgacgaggatctggcatccctgcgcgagcatgacgcgatccttcttggcgctatcggtgcaccaggttccgtccctccaggaattctcgagcgtggtttgctgctgaagatgcgattcgcactggatcaccacgtgaacctgcgcccatccaagctgtacgacggcgtggagtccccactgcgtaacccaggcaagattgatttcgttgtggtccgcgaaggtaccgaaggcgcctacactggcaacggtggagcaatccgcgtgggaacccctcacgagattgccaatgaaacctccgtgaacactcgctacggcgctgagcgcgttattcgctacgcattcgagctggcacagagccgccgcaagaagctcaccctcgtgcacaagaccaacgtcctggttcacggtggtggcctgtggcagcgcaccgtagatgaggttgcaaaggaatacccagaggtagccgtcgattacaaccacatcgatgcagcaaccatctatctggtcactgatccttcccgcttcgatgtgattgttaccgataacctcttcggcgacatcctcaccgatgaggcaggcgcagtctctggcggaattggcctcgcagcatccggcaacatcgatgccacgggcaccaacccttccatgttcgagccagtccacggctctgcaccagatatcgcaggccagggaatcgcagacccaacggcagcaatcctatccgctgcgatgctgctgcgtcacttaggtgatgaagacaacgcagtacgtattgaaacagccatcgcagctgatgtggctggccgagataactctcagccgatttctaccactgaggtgggagaccgcatcgtcaaggcgctgcaaagctaaatttcaacgccgaccccctt

SEQ ID NO: 270 - protein, 340 aa, Corynebacterium glutamicum
MKLAVIGGDGIGPEVTAEALKVLNAVRDDIETTDYDLGARRYLKNGELLTDEDLASLREHDAILLGAIGAPGSVPPGILERGLLLKMRFALDHHVNLRPSKLYDGVESPLRNPGKIDFVVVREGTEGAYTGNGGAIRVGTPHEIANETSVNTRYGAERVIRYAFELAQSRRKKLTLVHKTNVLVHGGGLWQRTVDEVAKEYPEVAVDYNHIDAATIYLVTDPSRFDVIVTDNLFGDILTDEAGAVSGGIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 271 - DNA, 403 bp, Corynebacterium glutamicum
  CDS (101)..(403): FRXA01132
gccctgcatgatggggtagtgggggttgttgggcaggtacgagctgtgatcaatcagctacactagtgaagtccatatagtgagaagggaatcccacaacatgaaacttgctgttattggtggagatggtatcggcccagaggttactgcagaagccctcaaggttctaaacgctgtccgcgacgacatcgagaccaccgattatgaccttggcgcacgccgttacctcaaaaatggcgagctgctcaccgacgaggatctggcatccctgcgcgagcatgacgcgatccttcttggcgctatcggtgcaccaggttccgtccctccaggaattctcgagcgtggtttgctgctgaagatgcgattcgcactggatcaccacgtgaacctgcgcccatccaag

SEQ ID NO: 272 - protein, 101 aa, Corynebacterium glutamicum
MKLAVIGGDGIGPEVTAEALKVLNAVRDDIETTDYDLGARRYLKNGELLTDEDLASLREHDAILLGAIGAPGSVPPGILERGLLLKMRFALDHHVNLRPSK

SEQ ID NO: 273 - DNA, 1494 bp, Corynebacterium glutamicum
  CDS (101)..(1471): RXN00536
cggcgggtcccagaggtcttaacacgaccggcatcccgtcgcggagtttggtgttgccggtcgtggacccacccaaaactttttaagaaggttgaacacaatgtctcctaacgatgcattcatctccgcacctgccaagatcgaaaccccagttgggcctcgcaacgaaggccagccagcatggaataagcagcgtggctcctcaatgccagttaaccgctacatgcctttcgaggttgaggtagaagatatttctctgccggaccgcacttggccagataaaaaaatcaccgttgcacctcagtggtgtgctgttgacctgcgtgacggcaaccaggctctgattgatccgatgtctcctgagcgtaagcgccgcatgtttgagctgctggttcagatgggcttcaaagaaatcgaggtcggtttcccttcagcttcccagactgattttgatttcgttcgtgagatcatcgaaaagggcatgatccctgacgatgtcaccattcaggttctggttcaggctcgtgagcacctgattcgccgtacttttgaagcttgcgaaggcgcaaaaaacgttatcgtgcacttctacaactccacctccatcctgcagcgcaacgtggtgttccgcatggacaaggtgcaggtgaagaagctggctaccgatgccgctgaactaatcaagaccatcgctcaggattacccagacaccaactggcgctggcagtactcccctgagtccttcaccggcactgaggttgagtacgccaaggaagttgtggacgcagttgttgaggtcatggatccaactcctgagaacccaatgatcatcaacctgccttccaccgttgagatgatcacccctaacgtttacgcagactccattgaatggatgcaccgcaatctaaaccgtcgtgattccattatcctgtccctgcacccgcacaatgaccgtggcaccggcgttggcgcagctgagctgggctacatggctggcgctgaccgcatcgaaggctgcctgttcggcaacggcgagcgcaccggcaacgtctgcctggtcaccctggcactgaacatgctgacccagggcgttgaccctcagctggacttcaccgatatacgccagatccgcagcaccgttgaatactgcaaccagctgcgcgttcctgagcgccacccatacggcggtgacctggtcttcaccgctttctccggttcccaccaggacgctgtgaacaagggtctggacgccatggctgccaaggttcagccaggtgctagctccactgaagtttcttgggagcagctgcgcgacacccgaatgggaggttccttacctgcctatcgatccaaaggatgtcggtcgcgactacgaggctgttatccgcgtgaactcccagtccggcaagggcggcgttgcttacatcatgaagaccgatcacggtctgcagatccctcgctccatgcaggttgagttctccaccgttgtccaga

SEQ ID NO: 274 - protein, 457 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKGMIPDDVTIQVLVQAREHLIRRTFEACEGAKNVIVHFYNSTSILQRNVVFRMDKVQVKKLATDAAELIKTIAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTRMGGSLPAYRSKGCRSRLRGCYPRELPVRQGRRCLHHEDRSRSADPSLHAG

SEQ ID NO: 275 - DNA, 1333 bp, Corynebacterium glutamicum
  CDS (101)..(1333): FRXA00536
cggcgggtcccagaggtcttaacacgaccggcatcccgtcgcggagtttggtgttgccggtcgtggacccacccaaaactttttaagaaggttgaacacaatgtctcctaacgatgcattcatctccgcacctgccaagatcgaaaccccagttgggcctcgcaacgaaggccagccagcatggaataagcagcgtggctcctcaatgccagttaaccgctacatgcctttcgaggttgaggtagaagatatttctctgccggaccgcacttggccagataaaaaaatcaccgttgcacctcagtggtgtgctgttgacctgcgtgacggcaaccaggctctgattgatccgatgtctcctgagcgtaagcgccgcatgtttgagctgctggttcagatgggcttcaaagaaatcgaggtcggtttcccttcagcttcccagactgattttgatttcgttcgtgagatcatcgaaaagggcatgatccctgacgatgtcaccattcaggttctggttcaggctcgtgagcacctgattcgccgtacttttgaagcttgcgaaggcgcaaaaaacgttatcgtgcacttctacaactccacctccatcctgcagcgcaacgtggtgttccgcatggacaaggtgcaggtgaagaagctggctaccgatgccgctgaactaatcaagaccatcgctcaggattacccagacaccaactggcgctggcagtactcccctgagtccttcaccggcactgaggttgagtacgccaaggaagttgtggacgcagttgttgaggtcatggatccaactcctgagaacccaatgatcatcaacctgccttccaccgttgagatgatcacccctaacgtttacgcagactccattgaatggatgcaccgcaatctaaaccgtcgtgattccattatcctgtccctgcacccgcacaatgaccgtggcaccggcgttggcgcagctgagctgggctacatggctggcgctgaccgcatcgaaggctgcctgttcggcaacggcgagcgcaccggcaacgtctgcctggtcaccctggcactgaacatgctgacccagggcgttgaccctcagctggacttcaccgatatacgccagatccgcagcaccgttgaatactgcaaccagctgcgcgttcctgagcgccacccatacggcggtgacctggtcttcaccgctttctccggttcccaccaggacgctgtgaacaagggtctggacgccatggctgccaaggttcagccaggtgctagctccactgaagtttcttgggagcagctgcgcgacaccgaatgggaggttcct

SEQ ID NO: 276 - protein, 411 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKGMIPDDVTIQVLVQAREHLIRRTFEACEGAKNVIVHFYNSTSILQRNVVFRMDKVQVKKLATDAAELIKTIAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTEWEVP

SEQ ID NO: 277 - DNA, 714 bp, Corynebacterium glutamicum
  CDS (101)..(691): RXN02965
caggaggccgcacccacctggtatccccagcagtcgcagccgccaccgaatccgcggaccctgtcctcacctgcagatatctaaggaaggctagaaaacaatggaaaaatttaccacctacaccggcgttggcgttccactgcagcgatccaacgtggacaccgaccagatcatcccagccgtctacctcaagcgcgtcacccggaccggcttcgaagacggactgttttccaactggcgccaaaacgaccccaactttgtcctcaacaccgacacctacaagaacggctccgttctcgtagcaggccctgactttggcaccggctcctcccgcgagcacgccgtctgggcactcatggactacggcttccgcgctgtcttctcctcacgattcgccgacatcttccgcggcaactccggaaaagcgggcatgctcaccggcatcatggaacagtccgacatcgaacttctgtggaagctcatggaacaaaccccaggcctcgaactgaccgtgaacctggaaaagcagatcgtcaccgcaggcgacgtagtgatcagcttcgaagttgacccctacatccgctggcgtttgatggaaggcctcgacgacgctggcctgaccctgcgcaagctcgatgaaattgaagactacgaggctaagcgccctgcgtttaagccacgcactaacgcttaagtttcagtctgatagcgaaa

SEQ ID NO: 278 - protein, 197 aa, Corynebacterium glutamicum
MEKFTTYTGVGVPLQRSNVDTDQIIPAVYLKRVTRTGFEDGLFSNWRQNDPNFVLNTDTYKNGSVLVAGPDFGTGSSREHAVWALMDYGFRAVFSSRFADIFRGNSGKAGMLTGIMEQSDIELLWKLMEQTPGLELTVNLEKQIVTAGDVVISFEVDPYIRWRLMEGLDDAGLTLRKLDEIEDYEAKRPAFKPRTNA

SEQ ID NO: 279 - DNA, 936 bp, Corynebacterium glutamicum
  CDS (101)..(913): RXN01929
aaaatttgactccataacgagaacttaatcgagcaacacccctgaacagtgaatcaaatcggaatttatttattctgagctggtcatcacatctatactcatgcccatgtcaggcattgatgcaaagaaaatccgcacccgtcatttccgcgaagctaaagtaaacggccagaaagtttcggttctcaccagctatgatgcgctttcggcgcgcatttttgatgaggctggcgtcgatatgctccttgttggtgattccgctgccaacgttgtgctgggtcgcgataccaccttgtcgatcaccttggatgagatgattgtgctggccaaggcggtgacgatcgctacgaagcgtgcgcttgtggtggttgatctgccgtttggtacctatgaggtgagcccaaatcaggcggtggagtccgcgatccgggtcatgcgtgaaacgggtgcggctgcggtgaagatcgagggtggcgtggagatcgcgcagacgattcgacgcattgttgatgctggaattccggttgtcggccacatcgggtacaccccgcagtccgagcattccttgggcggccacgtggttcagggtcgtggcgcgagttctggaaagctcatcgccgatgcccgcgcgttggagcaggcgggtgcgtttgcggttgtgttggagatggttccagcagaggcagcgcgcgaggttaccgaggatctttccatcaccactatcggaatcggtgccggcaatggcacagatgggcaggttttggtgtggcaggatgccttcggcctcaaccgcggcaagaagccacgcttcgtccgcgagtacgccaccttgggcgattccttgcacgacgccgcgcaggcctacatcgccgatatccacgcgggtaccttcccaggcgaagcggagtccttttaatgcaggtagcaaccacaaag

SEQ ID NO: 280 - protein, 271 aa, Corynebacterium glutamicum
MPMSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 281 - DNA, 930 bp, Corynebacterium glutamicum
  CDS (101)..(907): FRXA01929
tgactccataacgagaacttaatcgagcaacacccctgaacagtgaatcaaatcggaatttatttattctgagctggtcatcacatctatactcatgcccatgtcaggcattgatgcaaagaaaatccgcacccgtcatttccgcgaagctaaagtaaacggccagaaagtttcggttctcaccagctatgatgcgctttcggcgcgcatttttgatgaggctggcgtcgatatgctccttgttggtgattccgctgccaacgttgtgctgggtcgcgataccaccttgtcgatcaccttggatgagatgattgtgctggccaaggcggtgacgatcgctacgaagcgtgcgcttgtggtggttgatctgccgtttggtacctatgaggtgagcccaaatcaggcggtggagtccgcgatccgggtcatgcgtgaaacgggtgcggctgcggtgaagatcgagggtggcgtggagatcgcgcagacgattcgacgcattgttgatgctggaattccggttgtcggccacatcgggtacaccccgcagtccgagcattccttgggcggccacgtggttcagggtcgtggcgcgagttctggaaagctcatcgccgatgcccgcgcgttggagcaggcgggtgcgtttgcggttgtgttggagatggttccagcagaggcagcgcgcgaggttaccgaggatctttccatcaccactatcggaatcggtgccggcaatggcacagatgggcaggttttggtgtggcaggatgccttcggcctcaaccgcggcaagaagccacgcttcgtccgcgagtacgccaccttgggcgattccttgcacgacgccgcgcaggcctacatcgccgatatccacgcgggtaccttcccaggcgaagcggagtccttttaatgcaggtagcaaccacaaag

SEQ ID NO: 282 - protein, 269 aa, Corynebacterium glutamicum
MSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 283 - DNA, 1065 bp, Corynebacterium glutamicum
  CDS (101)..(1042): RXN01420
cgaagttcacgactacaggcattacctgggtgctgattttgcgcgagtaaagctgtggctgcggaatgcgctgctcatccacacgtggaatcctgattgggtgacgctgggtggattgaatgtaccatcgtggtcgctgggcgcggaaatgctgttctacctgacgttcccgctgtttattccgttagtgcgcaaagtgaagggcgtgggcaactggtgggcatttggcatcacctttgccgtgagcctggcgctgattacagtgattcacttttatgcggacggaccaaaggggattgagaacttctttgttcctcgcctgtgggacaccaatgtgtcaccggtcgcggaagttcacgccgatccagtgtggtttatgcaggaagaaattcccgtgctggaatcttactggctgtcttactacttcccgctgaccagactcatcgagttctacctcggtgtgtttggcgcgaagctggttgctgaaggcatgtttaaaaacaccaacatcaccatcccgctgatcgcactggctgtttcttttgttgctacttggtttgtgccactggcattcaagatgtctgtcatcatgtccctgccaatggcttttgttgtggcaacgcttgcggtgagagacattgaaggcaagagtggggaaatcgcctcgcctcgcgcagttttgttgggtaatatttcctttgccttctacatggtgcaattccccgtcatggtgtttgtgcagcgctatttcattgctggcaaagaatacggcttccttggctgggcattctatgcagtggtgtgtttcatcgtgtcggtcattctcgcgtgggtgctgtttaccttcgttgatgatcctttgatgaaggccacggcgcgcaagaaggggagtaggcgcttgaagcagtccaatattttggtccgtgacctgaaagttctcttcggcaaaagccccgaaaagccgttaaaagttgagactcgcgctgagaatctcacagaaaactccgaagctcccgctaaggtagctaccggaatcaaatcttagggaaggaaaacatatggcta

SEQ ID NO: 284 - protein, 314 aa, Corynebacterium glutamicum
VTLGGLNVPSWSLGAEMLFYLTFPLFIPLVRKVKGVGNWWAFGITFAVSLALITVIHFYADGPKGIENFFVPRLWDTNVSPVAEVHADPVWFMQEEIPVLESYWLSYYFPLTRLIEFYLGVFGAKLVAEGMFKNTNITIPLIALAVSFVATWFVPLAFKMSVIMSLPMAFVVATLAVRDIEGKSGEIASPRAVLLGNISFAFYMVQFPVMVFVQRYFIAGKEYGFLGWAFYAVVCFIVSVILAWVLFTFVDDPLMKATARKKGSRRLKQSNILVRDLKVLFGKSPEKPLKVETRAENLTENSEAPAKVATGIKS

SEQ ID NO: 285 - DNA, 1137 bp, Corynebacterium glutamicum
  CDS (101)..(1114): RXS01145
taatgtagttgtctgcccaagcgagttaaactcccacgatttacagtggggggcagacatcttttcaccaaaatttttacgaaaggcgagattttctcccatggctattgaactgctttatgatgctgacgctgacctctccttgatccagggccgtaaggttgccatcgttggctacggctcccagggccacgcacactcccagaacctccgcgattctggcgttgaggttgtcattggtctgcgcgagggctccaagtccgcagagaaggcaaaggaagcaggcttcgaggtcaagaccaccgctgaggctgcagcttgggctgacgtcatcatgctcctggctccagacacctcccaggcagaaatcttcaccaacgacatcgagccaaacctgaacgcaggcgacgcactgctgttcggccacggcctgaacattcacttcgacctgatcaagccagctgacgacatcatcgttggcatggttgcgccaaagggcccaggccacttggttcgccgtcagttcgttgatggcaagggtgttccttgcctcatcgcagtcgaccaggacccaaccggaaccgcacaggctctgaccctgtcctacgcagcagcaatcggtggcgcacgcgcaggcgttatcccaaccaccttcgaagctgagaccgtcaccgacctcttcggcgagcaggctgttctctgcggtggcaccgaggaactggtcaaggttggcttcgaggttctcaccgaagctggctacgagccagagatggcatacttcgaggttcttcacgagctcaagctcatcgttgacctcatgttcgaaggtggcatcagcaacatgaactactctgtttctgacaccgctgagttcggtggctacctctccggcccacgcgtcatcgatgcagacaccaagtcccgcatgaaggacatcctgaccgatatccaggacggcaccttcaccaagcgcctcatcgcaaacgttgagaacggcaacaccgagcttgagggccttcgtgcttcctacaacaaccacccaatcgaggagaccggcgctaagctccgcgacctcatgagctgggtcaaggttgacgctcgcgcagaaaccgcttaagtttcacccctttgacggct

SEQ ID NO: 286 - protein, 338 aa, Corynebacterium glutamicum
MAIELLYDADADLSLIQGRKVAIVGYGSQGHAHSQNLRDSGVEVVIGLREGSKSAEKAKEAGFEVKTTAEAAAWADVIMLLAPDTSQAEIFTNDIEPNLNAGDALLFGHGLNIHFDLIKPADDIIVGMVAPKGPGHLVRRQFVDGKGVPCLIAVDQDPTGTAQALTLSYAAAIGGARAGVIPTTFEAETVTDLFGEQAVLCGGTEELVKVGFEVLTEAGYEPEMAYFEVLHELKLIVDLMFEGGISNMNYSVSDTAEFGGYLSGPRVIDADTKSRMKDILTDIQDGTFTKRLIANVENGNTELEGLRASYNNHPIEETGAKLRDLMSWVKVDARAETA

SEQ ID NO: 287 - DNA, 556 bp, Corynebacterium glutamicum
  CDS (101)..(556): FRXA01145
taatgtagttgtctgcccaagcgagttaaactcccacgatttacagtggggggcagacatcttttcaccaaaatttttacgaaaggcgagattttctcccatggctattgaactgctttatgatgctgacgctgacctctccttgatccagggccgtaaggttgccatcgttggctacggctcccagggccacgcacactcccagaacctccgcgattctggcgttgaggttgtcattggtctgcgcgagggctccaagtccgcagagaaggcaaaggaagcaggcttcgaggtcaagaccaccgctgaggctgcagcttgggctgacgtcatcatgctcctggctccagacacctcccaggcagaaatcttcaccaacgacatcgagccaaacctgaacgcaggcgacgcactgctgttcggccacggcctgaacattcacttcgacctgatcaagccagctgacgacatcatcgttggcatggttgcgccaaagggcccaggccacttggttcgccgtcagttcgttgatggcaagggtgttccttgcctcatc

SEQ ID NO: 288 - protein, 152 aa, Corynebacterium glutamicum
MAIELLYDADADLSLIQGRKVAIVGYGSQGHAHSQNLRDSGVEVVIGLREGSKSAEKAKEAGFEVKTTAEAAAWADVIMLLAPDTSQAEIFTNDIEPNLNAGDALLFGHGLNIHFDLIKPADDIIVGMVAPKGPGHLVRRQFVDGKGVPCLI

SEQ ID NO: 289 - DNA, 1350 bp, Corynebacterium glutamicum
  CDS (101)..(1327): RXA02375
cttttcaggtctacgtgtatacgatggtaacgctatgaatgatacgcagaacacacctgaaagcgttcgattacgggataatctcccaacgccaacccaaatggcgccggtgacagggcttcctgtcaccccctacagccaggaagcaagcatcggtgcgagcttcccggcagtggatccggacaccaaagacagcgccgcatacggacatgaatccggaatgcgtgagcgcatctccaacgctaagcgagtggtggtgaaaattggttcgtcctcattgactaacgatgaggacggacacaccgtcgatcccaaccgcatcaacactattgtcaatgccttgcaagcacgcatggaagctggctcggacctcatcgttgtgtcctctggcgcagtggccgcgggaatggccccgcttggattgagcacccggcccacggaattggcagtcaagcaggctgcagcagcagtggggcaagttcacctcatgcaccagtggggacgttcttttgcccggtatggtcgccccatcggccaggtgcttcttaccgcagctgatgcaggaaagcgtgatcgtgcgaggaatgcgcagcgtaccatcgacaagctgcgcattttgggcgcggttcctatcgtcaatgaaaatgacaccgtggcaaccaccggtgtgaattttggtgacaacgaccgacttgctgcaattgtggcgcacctggtgtcggctgatgctttggtgctgctcagtgacgtggatggactttttgataaaaaccctactgatcccaccgcgaagtttatttccgaggttcgtgacggcaatgatttgaaaggtgtcattgccggcgacggcggaaaagtgggcaccggtggcatggcatcaaaggtgtctgctgcacgtttggcttcccgaagtggcgtgcctgtgctgttgacctctgcggcaaacattggcccagcactggaagacgcccaggtgggcactgtattccaccccaaggacaaccgcctctccgcgtggaagttctgggctttgtatgccgcagatactgcaggaaagatccgactcgatgacggcgcggtggaagcagtgacctccggtggtaaatctttgctggctgtgggcattactgaaatcattggtgatttccagcagggtgagatcgtggagatcttgggacctgccggccaaatcatcgggcgaggcgaggtgtcctacgattctgataccttgcaatcaatggttggtatgcaaacgcaggaccttccagatggcatgcagcgcccggtagtgcatgcagattatctgtccaactacgccagccgcgcgtaaagcgcgggcctgctggtggc

SEQ ID NO: 290 - protein, 409 aa, Corynebacterium glutamicum
MAPVTGLPVTPYSQEASIGASFPAVDPDTKDSAAYGHESGMRERISNAKRVVVKIGSSSLTNDEDGHTVDPNRINTIVNALQARMEAGSDLIVVSSGAVAAGMAPLGLSTRPTELAVKQAAAAVGQVHLMHQWGRSFARYGRPIGQVLLTAADAGKRDRARNAQRTIDKLRILGAVPIVNENDTVATTGVNFGDNDRLAAIVAHLVSADALVLLSDVDGLFDKNPTDPTAKFISEVRDGNDLKGVIAGDGGKVGTGGMASKVSAARLASRSGVPVLLTSAANIGPALEDAQVGTVFHPKDNRLSAWKFWALYAADTAGKIRLDDGAVEAVTSGGKSLLAVGITEIIGDFQQGEIVEILGPAGQIIGRGEVSYDSDTLQSMVGMQTQDLPDGMQRPVVHADYLSNYASRA

SEQ ID NO: 291 - DNA, 1419 bp, Corynebacterium glutamicum
  CDS (101)..(1396): RXN02382
gagcagatggccaccgaggtcgatgtggtggctggctactaggccttttatggtgtgatccgacactgttgcttcttaagggtctgtatagtgggcaaccatgagttcaacgaccctaactgatgaccaaattcgcgacaatgagcggaccgaagttctagctaaagcaactgcagctaagaacatcgtcccggatattgcagtgttgggcaccggaccgaagaacgcaatcctgcgtgcggcggcagatgaactcgttgcacgcagcgcagaaatcatcgaagccaacgcttccgatatcgaagcgggtcgcgcaaacggcatggaagaatccatgattgatcgccttgcccttgatgaatctcgcattgagggcatcgctggcggtttgcgccaggttgctggcctgaccgacccagtgggtgaagtactgcgcggacatgtcatggaaaacggcattcagatgaagcaggtccgtgtgcctttgggcgtgatgggcatggtctatgaagcccgccctaacgtcaccgtcgacgccttcggcctggcactcaagtccggaaacgtagctttgctgcgcggttcctccacagctgtgcattccaacaccaagctcgtggaaatcctgcaggacgtcctcgagcgtttcgagctgccacgcgaaaccgtgcagttgctgccttgccaaacccgcggatccgtccaagatttgatcaccgcacgcggcctcgttgacgtggtcatcccacgcggcggcgcaggactaatcaacgcagtggtcaccggtgcgaccgtgcccaccattgaaaccggcaccggcaactgccacttctacatcgatgccgaagccaagcttgatcaggcaatcgccatggtcatcaacggcaagacccgccgctgcagcgtgtgcaacgctactgaaaccgcgcttctcgacgccgccctcagcgactcagacaagcttgcagtcgtccaggcgctccaggaagcaggagtcacaattcatggacgggtggccgaattggaagcattcggtgcaaccgacgtggtggaagcaactgaaactgactgggattctgagtacctgtccttcgatatcgctgtcgctgtggttgacggtgtggatggagctctggcacacatcgctaagtacagcaccaagcacaccgaagcgatcgccacccaaaacattgaaaccgctcagcgctttgcagatcgcgtcgatgcagcagcggtgatgataaacgcatccaccgcctacaccgatggggagcagtacggcatgggcgcggagatcggcatttccacccagaaactgcatgcacgtggaccaatggccctgccagagctgacctccaccaagtggattctgcagggcacaggacaaattaggccttaagtttgaagaagtaatcaagc

SEQ ID NO: 292 - protein, 432 aa, Corynebacterium glutamicum
MSSTTLTDDQIRDNERTEVLAKATAAKNIVPDIAVLGTGPKNAILRAAADELVARSAEIIEANASDIEAGRANGMEESMIDRLALDESRIEGIAGGLRQVAGLTDPVGEVLRGHVMENGIQMKQVRVPLGVMGMVYEARPNVTVDAFGLALKSGNVALLRGSSTAVHSNTKLVEILQDVLERFELPRETVQLLPCQTRGSVQDLITARGLVDVVIPRGGAGLINAVVTGATVPTIETGTGNCHFYIDAEAKLDQAIAMVINGKTRRCSVCNATETALLDAALSDSDKLAVVQALQEAGVTIHGRVAELEAFGATDVVEATETDWDSEYLSFDIAVAVVDGVDGALAHIAKYSTKHTEAIATQNIETAQRFADRVDAAAVMINASTAYTDGEQYGMGAEIGISTQKLHARGPMALPELTSTKWILQGTGQIRP

SEQ ID NO: 293 - DNA, 724 bp, Corynebacterium glutamicum
  CDS (101)..(709): FRXA02378
gagcagatggccaccgaggtcgatgtggtggctggctactaggccttttatggtgtgatccgacactgttgcttcttaagggtctgtatagtgggcaaccatgagttcaacgaccctaactgatgaccaaattcgcgacaatgagcggaccgaagttctagctaaagcaactgcagctaagaacatcgtcccggatattgcagtgttgggcaccggaccgaagaacgcaatcctgcgtgcggcggcagatgaactcgttgcacgcagcgcagaaatcatcgaagccaacgcttccgatatcgaagcgggtcgcgcaaacggcatggaagaatccatgattgatcgccttgcccttgatgaatctcgcattgagggcatcgctggcggtttgcgccaggttgctggcctgaccgacccagtgggtgaagtactgcgcggacatgtcatggaaaacggcattcagatgaagcaggtccgtgtgcctttgggcgtgatgggcatggtctatgaagcccgccctaacgtcaccgtcgacgccttcggcctggcactcaagtccggaaacgtagctttgctgcgcggttcctccacagctgtgcattccaacaccaagctcgtggaaatcctgcaggacgtactcgagcgtttcgagctgccacgcgaaaccgtgcagttgctgcttgccaaacccgcggatccgtccaagatttgatcaccggacgcg

SEQ ID NO: 294 - protein, 203 aa, Corynebacterium glutamicum
MSSTTLTDDQIRDNERTEVLAKATAAKNIVPDIAVLGTGPKNAILRAAADELVARSAEIIEANASDIEAGRANGMEESMIDRLALDESRIEGIAGGLRQVAGLTDPVGEVLRGHVMENGIQMKQVRVPLGVMGMVYEARPNVTVDAFGLALKSGNVALLRGSSTAVHSNTKLVEILQDVLERFELPRETVQLLLAKPADPSKI

SEQ ID NO: 295 - DNA, 623 bp, Corynebacterium glutamicum
  CDS (1)..(600): FRXA02382
cccaccattgaaaccggcaccggcaactgccacttctacatcgatgccgaagccaagcttgatcaggcaatcgccatggtcatcaacggcaagacccgccgctgcagcgtgtgcaacgctactgaaaccgcgcttctcgacgccgccctcagcgactcagacaagcttgcagtcgtccaggcgctccaggaagcaggagtcacaattcatggacgggtggccgaattggaagcattcggtgcaaccgacgtggtggaagcaactgaaactgactgggattctgagtacctgtccttcgatatcgctgtcgctgtggttgacggtgtggatggagctctggcacacatcgctaagtacagcaccaagcacaccgaagcgatcgccacccaaaacattgaaaccgctcagcgctttgcagatcgcgtcgatgcagcagcggtgatgataaacgcatccaccgcctacaccgatggggagcagtacggcatgggcgcggagatcggcatttccacccagaaactgcatgcacgtggaccaatggccctgccagagctgacctccaccaagtggattctgcagggcacaggacaaattaggccttaagtttgaagaagtaatcaagc

SEQ ID NO: 296 - protein, 200 aa, Corynebacterium glutamicum
PTIETGTGNCHFYIDAEAKLDQAIAMVINGKTRRCSVCNATETALLDAALSDSDKLAVVQALQEAGVTIHGRVAELEAFGATDVVEATETDWDSEYLSFDIAVAVVDGVDGALAHIAKYSTKHTEAIATQNIETAQRFADRVDAAAVMINASTAYTDGEQYGMGAEIGISTQKLHARGPMALPELTSTKWILQGTGQIRP

SEQ ID NO: 297 - DNA, 933 bp, Corynebacterium glutamicum
  CDS (101)..(910): RXA02499
cctggtcatgacgttcgggccgctggcaatcgtcatgtaatttgtcgttttgggcccccgctgctgcaaaacaggggtggttagtggcagtgtgggaaccatgacaacaattgctgtaatcggcggcggacaaatcggcgaggctttagtctcaggtttgatcgcggccaacatgaatccacaaaatattcgcgtcaccaaccgttcggaagagcgcggccaagagctgcgtgaccgctacggcatcctcaacatgacggataattcccaagccgcagacgaagccgacgtggtgttcctgtgcgtgaagccgaaatttatcgtcgaagtgctctccgaaatcaccggcactttggataacaactccgcacaaagtgttgtggtcagcatggccgcaggcatcagcatcgctgccatggaagaaagcgcctctgcggggctccccgtcgtgcgcgtcatgccgaacactccaatgctcgtgggcaagggcatgtcgactgtcaccaaaggccgctacgttgacgcggaacagttggaacaagtcaaggacttgttgagcaccgttggagacgtcctcgaagtcgcggaatcagacatcgacgcagtcaccgcgatgtccggatcctcccctgcatacctgttccttgtgaccgaagcgctcattgaggcaggagttaatctaggcctgccccgcgcgaccgctaaaaagctcgctgtggcctcattcgaaggtgctgcaaccatgatgaaggaaaccggcaaagaaccctcagaattgcgcgcaggcgtttcctcacccgcaggcaccaccgtcgcagccatccgagaactcgaagaaagcggaatccgaggcgctttctaccgcgcagcccaagcttgcgccgaccgatctgaagaactcggaaagcgctagaaaccgttatttccccgtta

SEQ ID NO: 298 - protein, 270 aa, Corynebacterium glutamicum
MTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 299 - DNA, 1296 bp, Corynebacterium glutamicum; identical to SEQ ID NO: 59
  CDS (101)..(1273): RXS02157

SEQ ID NO: 300 - protein, 391 aa, Corynebacterium glutamicum; identical to SEQ ID NO: 60

SEQ ID NO: 301 - DNA, 1269 bp, Corynebacterium glutamicum
  CDS (101)..(1246): RXS02262
gcaccaatttcggacctgaaatccccgaggaaaccgtgcccgacgccgtgcaggtgggcgtcgataagcaaaaaatcgctgatactcgaaaggcctcaaaatgaccgcaacctacaccactgaaaccgccatcaatttcttgttcttgagcgaaccggacatgatcgcggccggagtcaaagacgtcgcgcaatgcgtcgatgtcatggaggaaacgctcgtgctcttggcgcagggcgactacaaaatggccggtttgaactccaactcgcatggcgcgatgatcaccttcccggaaaacccagaatttgaaggcatgcccaaggacggccccgaccgccgattcatggcgatgcccgcatacctcggcgggcgattcaaaaacaccggcgtgaagtggtacggatccaacgcggaaaacaaggcctcaggcttgcctcgctcgatccacaccttcgtcctcaacgacacggtcaccggtgcaccgaaggccatcatgtccgcgaacctgctgtccgcctaccgcaccggcgcggttcccggcgtgggcgtgaagcacttagcggtcgccgacgcgacaaccttggctgtcgtcggacctggtgtcatggcgaaaaccatcaccgaagcgtgcatcgcagagcgcccaggaatcaccaccatcaagatcaagggacgcagcgaacgcggcatcaacgcctttgcaacatgggcgttggaaaaattccccgagatcgaagtggtcgccgtcggatctgaagaagacgtggtcaaagacgccgacatcgtcatcgccgccaccaccacggacgccgccggctcctccgccttcccatacttcaaaaaagaatggctcaagccgggcgcattgctgctgcttccagccgccggtcgcttcgacgacgcttatttgcttgacgacgcccgcctcgttgttgactacatggggctctacgaagcctgggcagaagaatacggcccacaggcctaccaactactcggcattccaggaacccactggtacgacctggcgctgcaaggaaaactcgaccttgcaaagatttcccagattggcgatatctgctccggcaagctacccggacgcaccaacgatgaggaaatcatcctctattccgtcggcggcatgccagtagaagacgtcgcctgggcaacccaagtgtatgaaaacgccctggaaaaaggcgtcggcaccacattgaacctgtgggaatcacccgcactggcttgagagaagaaacaacaatgaaa

SEQ ID NO: 302 - protein, 382 aa, Corynebacterium glutamicum
MTATYTTETAINFLFLSEPDMIAAGVKDVAQCVDVMEETLVLLAQGDYKMAGLNSNSHGAMITFPENPEFEGMPKDGPDRRFMAMPAYLGGRFKNTGVKWYGSNAENKASGLPRSIHTFVLNDTVTGAPKAIMSANLLSAYRTGAVPGVGVKHLAVADATTLAVVGPGVMAKTITEACIAERPGITTIKIKGRSERGINAFATWALEKFPEIEVVAVGSEEDVVKDADIVIAATTTDAAGSSAFPYFKKEWLKPGALLLLPAAGRFDDAYLLDDARLVVDYMGLYEAWAEEYGPQAYQLLGIPGTHWYDLALQGKLDLAKISQIGDICSGKLPGRTNDEEIILYSVGGMPVEDVAWATQVYENALEKGVGTTLNLWESPALA

SEQ ID NO: 303 - DNA, 1491 bp, Corynebacterium glutamicum; identical to SEQ ID NO: 3
  CDS (101)..(1468): RXS02970

SEQ ID NO: 304 - protein, 456 aa, Corynebacterium glutamicum; identical to SEQ ID NO: 4

SEQ ID NO: 305 - DNA, 1330 bp, Corynebacterium glutamicum; identical to SEQ ID NO: 5
  CDS (101)..(1330): FRXA01009

SEQ ID NO: 306 - protein, 410 aa, Corynebacterium glutamicum; identical to SEQ ID NO: 6

SEQ ID NO: 307 - DNA, 3579 bp, Corynebacterium glutamicum
  CDS (101)..(3556): RXN00023
gggattatgttgggggccacatctgaaaatagttgctgggatccatcacacctacgatgcgaaacggcacccacaccgctgatcttgaaggagaaccaccatgacgtcgatgaatctgcctattgagttggctacgctgtctgaccaggctgtggacaaggtgcgctcctggctggagtacagcaaaaaggaaagcgtgcccaatgccgatgcgaagcgtctagctgcagtgttgcaggatcctaatggtttggaattcacggttggtttcgtggatcgagtggttcgaactgaggatcgtgaagcggcagcgcatgcgttgtatgagttgggcaagattgctccgtcgacgatgtcctttttggatcgggcgcagattcaggccggttctttggtggggcgggcgttgccgcaggttgtggttcctgcggcgcgggctcgaatccggcagatggttgggcacatgattgtggatgcccgcgacaagcagttcgccaaggctgtcgctgagattcagtcggatgggcaccgcctgaacatcaatttgctaggtgaagcggtgttgggccgaaaggaggcagcgaagcatttggatgacacggtgcggttgttgcgccgtccggatgtggaatatgtgtccatcaaggtctcttcggtggcatcgcagatttcgatgtggggtttcgaagacaccgttaattatgttgtggaacagctgacacctttatatatagaggccgcgcgggcgccgaaaggcacgaagttcatcaacctggacatggaggaataccgcgatctgcgcctgactatggaggtgttcaagcggctgctctccaatccagagctgcatgaactagaagccggaattgtgttgcaggcgtaccttcccgatgccctcggtgcaatccaggacttggcgcagttcggccgcgagcgcgtcaacacaggcggggcgggcgttaaggttcgcctggtcaagggtgctaatttgcctatggagcacgtccacgcgcagatcaccggctggccagttgccacagaaccttccaaacaagccaccgatgccaattacaagcgcgtcctctattggacgatgcgcaaagaaaacatggagggcctgcgcctgggcgttgccggccacaaccttttcgacatagcattcgcacatttgctctctgtggagcgtggggtagcggaccgtgtggagttcgaaatgctgcagggcatggcgtccgatcaggcgcgcgccgtcagcgttgacgtcggtgagctgctgctttacgtaccagccgtgcgcccacaagaattcgacgtggccatttcttacctcgtgcgccgcctcgaggaaaacgccgcgagcgaaaacttcatgtccgccatcttcgacctcgacgccgacaacccgtccttcaagcgagaggagagccgcttccgcgcctccatatctgacctcgccacgctcatcgacgtgcccgcgcccggccccaaccacacacaagaccgcagcaaagagacgcttctcgacgcccccctcgtcccatttatcaacgagcccgacaccaacccagcgctcatccaaaaccaacagtgggccacaaaagccgtcgccaccgcagcagagcccggttggttggaaaaacaaacaaagccggaggtgttggaagagggggacgtcgacaagctaattaacgatgtgcgcgacgctgctgaagcgtgggcagcgcgcccagcccgtgaacgcgctgagattttgtacaagaccgccgagattttgcgcgtgcgacgcggacacctgatctcagtgacggccgcggaggtgggcaaagctgtggaacaaaccgacccggaaatctctgaagccattgatttcgcccgctactacgcgcatttggccctggaattggacgacgtagacaatgcggaattcaccccagatcgcgtcgttgtggtgaccccgccctggaatttccccatcgcgatccccgctggatcgactttcgcagcactcgcggcgggcgctggcgtgatccacaaaccctcaaagcctagccaacattgctccgctgcagtggtcgaagccctctgggaagccggcgttccccgcgaggttctgcattgcatttacccagctaatcgcgatgttggatgtgcgttgatcagccatgaacacgtcgaccgcgtcattttgaccggctcctccgagaccgccgcgatgttctcctcctggcgaccagaactcaccatcaacggcgaaacctccggcaaaaacgccatcgtggtcaccccatctgccgaccgcgacctcgccgtcgccgacctggtgaaatccgccttcggccatgcaggacaaaaatgttccgcagcctccctcggcatcttggtaggcagcgtctacgaatcagaacgcttccggaaacagctggtagacgccgcatcctcactcatcgtcgactggcctaccaacccctccgcaaccgtcggaccactcaccgaactccccagcgataaactccaccacgccctaaccaccctcgaagaaggagaaagctggctgctgaaaccccgacaactcgacgacaccggccgactctggtcacccggcatcaaagaaggcgtcaaaccaggaaccttcttccacctcacagaagtattcggaccagtcctcggcctgatgaaagccaccgacctcaatgaagccatcgaattccaaaacggcaacgacttcggactcaccggcggactccaatccctcgacgccgacgaagtccgcacctggcttgaccacgtcgatgtcggaaacgcctacgtcaaccgcggcatcaccggcgccattgtccaacgccaatccttcggaggctggaaaaaatcctccgtcggcctcggatccaaagccggaggacccaactatgtcatgctcatgggaacctgggccgacgcgccaagccaccacgccccacgcgaaacaaacccgctgatcagcaaactggatctccccggagaagagctcgaatggctcgaaaaagccaacgccagcgatgaaacagcatggaacacggaattcggcagcccacgcgacccctccggcctcgatgtagaagccaacattttccgctaccgaccagcagaggtagtactccgactcgacgattccgccacaccccgagaaactgcccgcgcattgttggcagcccgtcgcgccggggttactccgcgagttcttcaaacaccaggtgtttcagagcaagtccgcgaagtattgtccgctgctggagtgagtgcagaaacagtcgatgattcggtatttatttccaacgtgttgcgcggcgaatacgacgagaactccagcgtccgagtccgctacctgggcaaagttagcgacactgtccgtgaacgcctatctgtacggcccgaagttgttctgcttgacgatgcagtaactgcctccggtcgagttgaattacgttactggctcaaagaacaagcaatttccatgacgttgcaccgttttggaaacccagttgcggccttccacgagttggcggaggaacttaaacgttgatcgttttgcgcatgggtcgc

SEQ ID NO: 308 - protein, 1152 aa, Corynebacterium glutamicum
MTSMNLPIELATLSDQAVDKVRSWLEYSKKESVPNADAKRLAAVLQDPNGLEFTVGFVDRVVRTEDREAAAHALYELGKIAPSTMSFLDRAQIQAGSLVGRALPQVVVPAARARIRQMVGHMIVDARDKQFAKAVAEIQSDGHRLNINLLGEAVLGRKEAAKHLDDTVRLLRRPDVEYVSIKVSSVASQISMWGFEDTVNYVVEQLTPLYIEAARAPKGTKFINLDMEEYRDLRLTMEVFKRLLSNPELHELEAGIVLQAYLPDALGAIQDLAQFGRERVNTGGAGVKVRLVKGANLPMEHVHAQITGWPVATEPSKQATDANYKRVLYWTMRKENMEGLRLGVAGHNLFDIAFAHLLSVERGVADRVEFEMLQGMASDQARAVSVDVGELLLYVPAVRPQEFDVAISYLVRRLEENAASENFMSAIFDLDADNPSFKREESRFRASISDLATLIDVPAPGPNHTQDRSKETLLDAPLVPFINEPDTNPALIQNQQWATKAVATAAEPGWLEKQTKPEVLEEGDVDKLINDVRDAAEAWAARPARERAEILYKTAEILRVRRGHLISVTAAEVGKAVEQTDPEISEAIDFARYYAHLALELDDVDNAEFTPDRVVVVTPPWNFPIAIPAGSTFAALAAGAGVIHKPSKPSQHCSAAVVEALWEAGVPREVLHCIYPANRDVGCALISHEHVDRVILTGSSETAAMFSSWRPELTINGETSGKNAIVVTPSADRDLAVADLVKSAFGHAGQKCSAASLGILVGSVYESERFRKQLVDAASSLIVDWPTNPSATVGPLTELPSDKLHHALTTLEEGESWLLKPRQLDDTGRLWSPGIKEGVKPGTFFHLTEVFGPVLGLMKATDLNEAIEFQNGNDFGLTGGLQSLDADEVRTWLDHVDVGNAYVNRGITGAIVQRQSFGGWKKSSVGLGSKAGGPNYVMLMGTWADAPSHHAPRETNPLISKLDLPGEELEWLEKANASDETAWNTEFGSPRDPSGLDVEANIFRYRPAEVVLRLDDSATPRETARALLAARRAGVTPRVLQTPGVSEQVREVLSAAGVSAETVDDSVFISNVLRGEYDENSSVRVRYLGKVSDTVRERLSVRPEVVLLDDAVTASGRVELRYWLKEQAISMTLHRFGNPVAAFHELAEELKR

SEQ ID NO: 309 - DNA, 476 bp, Corynebacterium glutamicum
  CDS (1)..(453): FRXA00023
cattttccgctccgaccagcagaggtagtactccgactcgacgattccgccacaccccgagaaactgcccgcgcattgttggcagcccgtcgcgccggggttactccgcgagttcttcaaacaccaggtgtttcagagcaagtccgcgaagtattgtccgctgctggagtgagtgcagaaacagtcgatgattcggtatttatttccaacgtgttgcgcggcgaatacgacgagaactccagcgtccgagtccgctacctgggcaaagttagcgacactgtccgtgaacgcctatctgtacggcccgaagttgttctgcttgacgatgcagtaactgcctccggtcgagttgaattacgttactggctcaaagaacaagcaatttccatgacgttgcaccgttttggaaacccagttgcggccttccacgagttggcggaggaacttaaacgttgatcgttttgcgcatgggtcgc

SEQ ID NO: 310 - protein, 151 aa, Corynebacterium glutamicum
HFPLRPAEVVLRLDDSATPRETARALLAARRAGVTPRVLQTPGVSEQVREVLSAAGVSAETVDDSVFISNVLRGEYDENSSVRVRYLGKVSDTVRERLSVRPEVVLLDDAVTASGRVELRYWLKEQAISMTLHRFGNPVAAFHELAEELKR

SEQ ID NO: 311 - DNA, 3124 bp, Corynebacterium glutamicum
  CDS (101)..(3124): FRXA02284
  misc_feature (641)..(647): n = a, g, c, or t
  VARIANT (181)..(182): Xaa = any amino acid
  VARIANT 183: Xaa = Phe, Leu, Ile, or Val
gggattatgttgggggccacatctgaaaatagttgctgggatccatcacacctacgatgcgaaacggcacccacaccgctgatcttgaaggagaaccaccatgacgtcgatgaatctgcctattgagttggctacgctgtctgaccaggctgtggacaaggtgcgctcctggctggagtacagcaaaaaggaaagcgtgcccaatgccgatgcgaagcgtctagctgcagtgttgcaggatcctaatggtttggaattcacggttggtttcgtggatcgagtggttcgaactgaggatcgtgaagcggcagcgcatgcgttgtatgagttgggcaagattgctccgtcgacgatgtcctttttggatcgggcgcagattcaggccggttctttggtggggcgggcgttgccgcaggttgtggttcctgcggcgcgggctcgaatccggcagatggttgggcacatgattgtggatgcccgcgacaagcagttcgccaaggctgtcgctgagattcagtcggatgggcaccgcctgaacatcaatttgctaggtgaagcggtgttgggccgaaaggaagcagcgaagcatttggatgacacggtgcggttgttgcgccgtccggatgtggaatatgtgtcnnnnnnnntctcttcggtggcatcgcagatttcgatgtggggtttcgaagacaccgttaattatgttgtggaacagctgacacctttatatatagagcccgcgcgggcgccgaaaggcacgaagttcatcaacctggacatggaggaataccgcgatctgcgcctgactatggaggtgttcaagcggctgctctccaatccagagctgcatgaactagaagccggaattgtgttgcaggcgtaccttcccgatgccctcggtgcaatccaggacttggcgcagttcggccgcgagcgcgtcaacacaggcggggcgggcgttaaggttcgcctggtcaagggtgctaatttgcctatggagcacgtccacgcgcagatcaccggctggccagttgccacagaaccttccaaacaagccaccgatgccaattacaagcgcgtcctctattggacgatgcgcaaagaaaacatggagggcctgcgcctgggcgttgccggccacaaccttttcgacatagcattcgcacatttgctctctgtggagcgtggggtagcggaccgtgtggagttcgaaatgctgcagggcatggcgtccgatcaggcgcgcgccgtcagcgttgacgtcggtgagctgctgctttacgtaccagccgtgcgcccacaagaattcgacgtggccatttcttacctcgtgcgccgcctcgaggaaaacgccgcgagcgaaaacttcatgtccgccatcttcgacctcgacgccgacaacccgtccttcaagcgagaggagagccgcttccgcgcctccatatctgacctcgccacgctcatcgacgtgcccgcgcccggccccaaccacacacaagaccgcagcaaagagacgcttctcgacgcccccctcgtcccatttatcaacgagcccgacaccaacccagcgctcatccaaaaccaacagtgggccacaaaagccgtcgccaccgcagcagagcccggttggttggaaaaacaaacaaagccggaggtgttggaagagggggacgtcgacaagctaattaacgatgtgcgcgacgctgctgaagcgtgggcagcgcgcccagcccgtgaacgcgctgagattttgtacaagaccgccgagattttgcgcgtgcgacgcggacacctgatctcagtgacggccgcggaggtgggcaaagctgtggaacaaaccgacccggaaatctctgaagccattgatttcgcccgctactacgcgcatttggccctggaattggacgacgtagacaatgcggaattcaccccagatcgcgtcgttgtggtgaccccgccctggaatttccccatcgcgatccccgctggatcgactttcgcagcactcgcggcgggcgctggcgtgatccacaaaccctcaaagcctagccaacattgctccgctgcagtggtcgaagccctctgggaagccggcgttccccgcgaggttctgcattgcatttacccagctaatcgcgatgttggatgtgcgttgatcagccatgaacacgtcgaccgcgtcattttgaccggctcctccgagaccgccgcgatgttctcctcctggcgaccagaactcaccatcaacggcgaaacctccggcaaaaacgccatcgtggtcaccccatctgccgaccgcgacctcgccgtcgccgacctggtgaaatccgccttcggccatgcaggacaaaaatgttccgcagcctccctcggcatcttggtaggcagcgtctacgaatcagaacgcttccggaaacagctggtagacgccgcatcctcactcatcgtcgactggcctaccaacccctccgcaaccgtcggaccactcaccgaactccccagcgataaactccaccacgccctaaccaccctcgaagaaggagaaagctggctgctgaaaccccgacaactcgacgacaccggccgactctggtcacccggcatcaaagaaggcgtcaaaccaggaaccttcttccacctcacagaagtattcggaccagtcctcggcctgatgaaagccaccgacctcaatgaagccatcgaattccaaaacggcaacgacttcggactcaccggcggactccaatccctcgacgccgacgaagtccgcacctggcttgaccacgtcgatgtcggaaacgcctacgtcaaccgcggcatcaccggcgccattgtccaacgccaatccttcggaggctggaaaaaatcctccgtcggcctcggatccaaagccggaggacccaactatgtcatgctcatgggaacctgggccgacgcgccaagccaccacgccccacgcgaaacaaacccgctgatcagcaaactggatctccccggagaagagctcgaatggctcgaaaaagccaacgccagcgatgaaacagcatggaacacggaattcggcagcccacgcgacccctccggcctcgatgtagaagccaacattttccgctaccgaccagca

SEQ ID NO: 312 - protein, 1008 aa, Corynebacterium glutamicum
  VARIANT (181)..(182): Xaa = any amino acid
  VARIANT 183: Xaa = Phe, Leu, Ile, or Val
MTSMNLPIELATLSDQAVDKVRSWLEYSKKESVPNADAKRLAAVLQDPNGLEFTVGFVDRVVRTEDREAAAHALYELGKIAPSTMSFLDRAQIQAGSLVGRALPQVVVPAARARIRQMVGHMIVDARDKQFAKAVAEIQSDGHRLNINLLGEAVLGRKEAAKHLDDTVRLLRRPDVEYVSXXXSSVASQISMWGFEDTVNYVVEQLTPLYIEPARAPKGTKFINLDMEEYRDLRLTMEVFKRLLSNPELHELEAGIVLQAYLPDALGAIQDLAQFGRERVNTGGAGVKVRLVKGANLPMEHVHAQITGWPVATEPSKQATDANYKRVLYWTMRKENMEGLRLGVAGHNLFDIAFAHLLSVERGVADRVEFEMLQGMASDQARAVSVDVGELLLYVPAVRPQEFDVAISYLVRRLEENAASENFMSAIFDLDADNPSFKREESRFRASISDLATLIDVPAPGPNHTQDRSKETLLDAPLVPFINEPDTNPALIQNQQWATKAVATAAEPGWLEKQTKPEVLEEGDVDKLINDVRDAAEAWAARPARERAEILYKTAEILRVRRGHLISVTAAEVGKAVEQTDPEISEAIDFARYYAHLALELDDVDNAEFTPDRVVVVTPPWNFPIAIPAGSTFAALAAGAGVIHKPSKPSQHCSAAVVEALWEAGVPREVLHCIYPANRDVGCALISHEHVDRVILTGSSETAAMFSSWRPELTINGETSGKNAIVVTPSADRDLAVADLVKSAFGHAGQKCSAASLGILVGSVYESERFRKQLVDAASSLIVDWPTNPSATVGPLTELPSDKLHHALTTLEEGESWLLKPRQLDDTGRLWSPGIKEGVKPGTFFHLTEVFGPVLGLMKATDLNEAIEFQNGNDFGLTGGLQSLDADEVRTWLDHVDVGNAYVNRGITGAIVQRQSFGGWKKSSVGLGSKAGGPNYVMLMGTWADAPSHHAPRETNPLISKLDLPGEELEWLEKANASDETAWNTEFGSPRDPSGLDVEANIFRYRPA

SEQ ID NO: 313 - DNA, 927 bp, Corynebacterium glutamicum
  CDS (101)..(904): RXC02498
caaggtagaaatttgtccgtgggcacttcgtgaaggtgtgatcctcaccaggatcgacaaaggactcgagtaacatttacccggaaaggagttggcgaaaatgagtgaagagaaactcacagtcgctgagctgatggcgcgtgccgcgaaagagggacgctccaccgatgctccccgacgacgcaggcgccgcagcatcgaagacggtggcgtatccgttgctgagctgaccggctccattcctgccgttaaggaaaagcccgcggagtccaagcactccagcgtgcccatcgatgcaccagcagaacctgaggttgttgaggcccccaagcctgagcccgccgaagaagtagaagtggcttcggtggagggcgacgtcgataagcaggaaacccctgagcgtccggcgccgagcaacgaagaaaccatggtgctgcgcatcgtggatgaaaaagatccaattagcttgacgacgggcgcgttccccgtggttccggcagttgccgccaagccggcgcccgtagtgcgcgcggagaaggacgccgatgtggagactgccgtaaaggcagatttcgcagaggtggaagtcgataacactgacaccacgcagatggctgtggtggaagaagttgacgaggagccagagcaagaaaacaaaatgtccgtattcgcgatcatcatgatggcgatcgtcggagttgttctcggtgtcgttgtattcctcggctttgaaatgctgtgggagcgcctgaacaagtggatcgtcgctgttctggcagtcggcgtgaccttgggaatggtgggcatcatccacgctttgcgcacctcacgtgatggtttcagcatggttctcgcaggaatcgtgggcctggtcatgacgttcgggccgctggcaatcgtcatgtaatttgtcgttttgggcccccg

SEQ ID NO: 314 - protein, 268 aa, Corynebacterium glutamicum
MSEEKLTVAELMARAAKEGRSTDAPRRRRRRSIEDGGVSVAELTGSIPAVKEKPAESKHSSVPIDAPAEPEVVEAPKPEPAEEVEVASVEGDVDKQETPERPAPSNEETMVLRIVDEKDPISLTTGAFPVVPAVAAKPAPVVRAEKDADVETAVKADFAEVEVDNTDTTQMAVVEEVDEEPEQENKMSVFAIIMMAIVGVVLGVVVFLGFEMLWERLNKWIVAVLAVGVTLGMVGIIHALRTSRDGFSMVLAGIVGLVMTFGPLAIVM

SEQ ID NO: 315 - DNA, 774 bp, Corynebacterium glutamicum
  CDS (101)..(751): RXA01491
aacggtgtgaaacacattgaagtgtcgttgggttatccgcgcgaatgggagcattggtctgggcagcatgtgtggccatatccagtgatggaggtggacaatgctggatgagtctttgtttccaaattcggcaaagttttctttcattaaaactggcgatgctgttaatttagaccatttccatcagttgcatccgttggaaaaggcactggtagcgcactcggttgatattagaaaagcagagtttggagatgccaggtggtgtgcacatcaggcactccaagctttgggacgagatagcggtgatcccattttgcgtggggaacgaggaatgccattgtggccttcttcggtgtctggttcattgacccacactgacggattccgagctgctgttgtggcgccacgattgttggtgcgttctatgggattggatgccgaacctgcggagccgttgcccaaggatgttttgggttcaatcgctcgggtgggggagattcctcaacttaagcgcttggaggaacaaggtgtgcactgcgcggatcgcctgctgttttgtgccaaggaagcaacatacaaagcgtggttcccgctgacgcataggtggcttggttttgaacaagctgagatcgacttgcgtgatgatggcacttttgtgtcctatttgctggttcgaccaactccagtgccgtttatttcaggtaaatgggtactgcgtgatggttatgtcatagctgcgactgcagtgacttgaactggatggagaggatacct

SEQ ID NO: 316 - protein, 217 aa, Corynebacterium glutamicum
MLDESLFPNSAKFSFIKTGDAVNLDHFHQLHPLEKALVAHSVDIRKAEFGDARWCAHQALQALGRDSGDPILRGERGMPLWPSSVSGSLTHTDGFRAAVVAPRLLVRSMGLDAEPAEPLPKDVLGSIARVGEIPQLKRLEEQGVHCADRLLFCAKEATYKAWFPLTHRWLGFEQAEIDLRDDGTFVSYLLVRPTPVPFISGKWVLRDGYVIAATAVT

SEQ ID NO: 317 - DNA, 1287 bp, Corynebacterium glutamicum
  CDS (101)..(1264): RXA02155
tcggcgtcgcaccttaaagtagcgccttaaagcggcgcttcaaaccaagcgccctaaccagcaaacacaacaaacacatctaattcagtaggagttccacatggcagaaaaaggcattaccgcgccgaaaggcttcgttgcttctgcaacgaccgcgggtattaaagcttctggcaatcctgacatggcgttggtggttaaccagggtccagagttttccgcagcggccgtgtttacacgtaaccgagttttcgcagcgcctgtgaaggtgagccgagagaacgttgctgatggccagatcagggctgttttgtacaacgctggtaatgctaatgcgtgtaatggtctgcagggtgagaaggatgctcgtgagtctgtttctcatctagctcaaaatttgggcttggaggattccgatattggtgtgtgttccactggtcttattggtgagttgcttccgatggataagctcaatgcaggtattgatcagctgaccgctgagggcgctttgggtgacaatggtgcagctgctgccaaggcgatcatgaccactgacacggtggataaggaaaccgtcgtgtttgctgatggttggactgtcggcggaatgggcaagggcgtgggcatgatggcgccgtctcttgccaccatgctggtctgcttgaccactgatgcatccgttactcaggaaatggctcagatcgcgctggctaatgctacggccgttacgtttgacaccctggatattgatggatcaacctccaccaatgacaccgtgttcctgctggcatctggcgctagcggaatcaccccaactcaggatgaactcaacgatgcggtgtacgcagcttgttctgatatcgcagcgaagcttcaggctgatgcagagggtgtgaccaagcgcgttgctgtgacagtggtgggaaccaccaacaacgagcaggcgattaatgcggctcgcactgttgctcgtgacaatttgttcaagtgcgcaatgtttggatctgatccaaactggggtcgcgtgttggctgcagtcggcatggctgatgctgatatggaaccagagaagatttctgtgttcttcaatggtcaagcagtatgccttgattccactggcgctcctggtgctcgtgaggtggatctttccggcgctgacattgatgtccgaattgatttgggcaccagtggggaaggccaggcaacagttcgaaccactgacctgagcttctcctacgtggagatcaactccgcgtacagctcttaaaaagaaacagcactccaact

SEQ ID NO: 318 - protein, 388 aa, Corynebacterium glutamicum
MAEKGITAPKGFVASATTAGIKASGNPDMALVVNQGPEFSAAAVFTRNRVFAAPVKVSRENVADGQIRAVLYNAGNANACNGLQGEKDARESVSHLAQNLGLEDSDIGVCSTGLIGELLPMDKLNAGIDQLTAEGALGDNGAAAAKAIMTTDTVDKETVVFADGWTVGGMGKGVGMMAPSLATMLVCLTTDASVTQEMAQIALANATAVTFDTLDIDGSTSTNDTVFLLASGASGITPTQDELNDAVYAACSDIAAKLQADAEGVTKRVAVTVVGTTNNEQAINAARTVARDNLFKCAMFGSDPNWGRVLAAVGMADADMEPEKISVFFNGQAVCLDSTGAPGAREVDLSGADIDVRIDLGTSGEGQATVRTTDLSFSYVEINSAYSS

SEQ ID NO: 319 - DNA, 1074 bp, Corynebacterium glutamicum
  CDS (101)..(1051): RXA02156
aaccactgacctgagcttctcctacgtggagatcaactccgcgtacagctcttaaaaagaaacagcactccaactaacaagcagggaaaagggcacaggcatgaatgacttgatcaaagatttaggctctgaggtgcgcgcaaatgtcctcgctgaggcgttgccatggttgcagcacttccgcgacaagattgttgtcgtgaaatatggcggaaacgccatggtggatgatgatctcaaggctgcttttgctgccgacatggtcttcttgcgcaccgtgggcgcaaaaccagtggtggtgcacggtggtggacctcagatttctgagatgctaaaccgtgtgggtctccagggcgagttcaagggtggtttccgtgtgaccactcctgaggtcatggacattgtgcgcatggtgctctttggtcaggtcggtcgcgatttagttggtttgatcaactctcatggcccttacgctgtgggaacctccggtgaggatgccggcctgtttaccgcgcagaagcgcatggtcaacatcgatggcgtacccactgatattggtttggtcggagacatcattaatgtcgatgcctcttccttgatggatatcatcgaggccggtcgcattcctgtggtctctacgattgctccaggcgaagacggccagatttacaacattaacgccgataccgcagcaggtgctttggctgcagcgattggtgcagaacgcctgctggttctcaccaatgtggaaggtctgtacaccgattggcctgataagagctcactggtgtccaagatcaaggccaccgagctggaggccattcttccgggacttgattccggcatgattccaaagatggagtcttgcttgaacgcggtgcgtgggggagtaagcgctgctcatgtcattgacggccgcatcgcgcactcggtgttgctggagcttttgaccatgggtggaattggcacgatggtgctgccggatgtttttgatcgggagaattatcctgaaggcaccgtttttagaaaagacgacaaggatggggaactgtaaatgagcacgctggaaacttg

SEQ ID NO: 320 - protein, 317 aa, Corynebacterium glutamicum
MNDLIKDLGSEVRANVLAEALPWLQHFRDKIVVVKYGGNAMVDDDLKAAFAADMVFLRTVGAKPVVVHGGGPQISEMLNRVGLQGEFKGGFRVTTPEVMDIVRMVLFGQVGRDLVGLINSHGPYAVGTSGEDAGLFTAQKRMVNIDGVPTDIGLVGDIINVDASSLMDIIEAGRIPVVSTIAPGEDGQIYNINADTAAGALAAAIGAERLLVLTNVEGLYTDWPDKSSLVSKIKATELEAILPGLDSGMIPKMESCLNAVRGGVSAAHVIDGRIAHSVLLELLTMGGIGTMVLPDVFDRENYPEGTVFRKDDKDGEL

SEQ ID NO: 321 - DNA, 903 bp, Corynebacterium glutamicum
  CDS (101)..(880): RXN02153
cccacttgcagttttagctgtaggtgggtttttgcatgtctaacccgtcttttatgcacacccccgcaatgaatcaaaaatttatgcatgaataatttgcatgatcatgcataacgtgtatggtgtaactatgacaatcaaggttgcaatcgcaggagccagtggatatgccggcggagaaatccttcgtctccttttaggccatccagcttatgcatctggtgaactagaaatcggagcactcaccgcggcatcaaccgcaggcagcacgctcggtgaattgatgccacacattccgcagttggcggatcgtgttattcaagacaccacagctgaaactctagccggtcatgatgtcgtatttctaggacttccacacggattctctgcagaaattgcacttcagctcggaccagatgtcacagtgattgactgtgcagctgactttcgtctgcaaaatgctgcagattgggagaagttctacggctcagagcaccagggaacatggccttatggcattccagaaatgccaggacaccgcgaggctcttcgtggtgctaagcgtgtagcagtgccaggatgtttcccaaccggtgcaaccttggctcttcttcctgcggttcaagcgggacttatcgagccagatgtttccgtagtgtccatcaccggcgtatcaggtgcaggtaagaaagcatctgttgcactacttggctcggaaaccatgggttcactcaaggcgtacaacacctccggaaagcaccgccacaccccggaaattgcccagaacctcggcgaagtcagcgacaagccagtcaaggtgagcttcaccccagtgcttgcaccgttacctcgcgaattctcaccactgcaaccgcacctttgaaagaaggcgttaccgcagaa

SEQ ID NO: 322 - protein, 260 aa, Corynebacterium glutamicum
MIMHNVYGVTMTIKVAIAGASGYAGGEILRLLLGHPAYASGELEIGALTAASTAGSTLGELMPHIPQLADRVIQDTTAETLAGHDVVFLGLPHGFSAEIALQLGPDVTVIDCAADFRLQNAADWEKFYGSEHQGTWPYGIPEMPGHREALRGAKRVAVPGCFPTGATLALLPAVQAGLIEPDVSVVSITGVSGAGKKASVALLGSETMGSLKAYNTSGKHRHTPEIAQNLGEVSDKPVKVSFTPVLAPLPREFSPLQPHL

SEQ ID NO: 323 - DNA, 903 bp, Corynebacterium glutamicum; identical to SEQ ID NO: 321
  CDS (101)..(880): FRXA02153

SEQ ID NO: 324 - protein, 260 aa, Corynebacterium glutamicum; identical to SEQ ID NO: 322

SEQ ID NO: 325 - DNA, 414 bp, Corynebacterium glutamicum
  CDS (101)..(391): RXA02154
cccagaacctcggcgaagtcagcgacaagccagtcaaggtgagcttcaccccagtgcttgcaccgttacctcgcgaattctcaccactgcaaccgcacctttgaaagaaggcgttaccgcagaacaggctcgcgcagtatatgaagagttctatgcacaggaaaccttcgtgcatgttcttccagaaggtgcacagccacaaacccaagcagttcttggctccaacatgtgccacgtgcaggtagaaattgatgaggaagcaggcaaagtccttgttacctccgcaatcgataacctcaccaagggaactgccggcgccgctgttcagtgcatgaacttaagcgttggttttgatgaggcagcaggcctgccacaggtcggcgtcgcaccttaaagtagcgccttaaagcggcg

SEQ ID NO: 326 - protein, 97 aa, Corynebacterium glutamicum
LKEGVTAEQARAVYEEFYAQETFVHVLPEGAQPQTQAVLGSNMCHVQVEIDEEAGKVLVTSAIDNLTKGTAGAAVQCMNLSVGFDEAAGLPQVGVAP

SEQ ID NO: 327 - DNA, 1296 bp, Corynebacterium glutamicum; identical to SEQ ID NO: 59
  CDS (101)..(1273): RXA02157

SEQ ID NO: 328 - protein, 391 aa, Corynebacterium glutamicum; identical to SEQ ID NO: 60

SEQ ID NO: 329 - DNA, 1491 bp, Corynebacterium glutamicum; identical to SEQ ID NO: 3
  CDS (101)..(1468): RXS02970

SEQ ID NO: 330 - protein, 456 aa, Corynebacterium glutamicum; identical to SEQ ID NO: 4

SEQ ID NO: 331 - DNA, 1330 bp, Corynebacterium glutamicum; identical to SEQ ID NO: 5
  CDS (101)..(1330): FRXA01009

SEQ ID NO: 332 - protein, 410 aa, Corynebacterium glutamicum; identical to SEQ ID NO: 6

SEQ ID NO: 333 - DNA, 1080 bp, Corynebacterium glutamicum
  CDS (101)..(1057): RXA02158
aacattatccgtttgaccccgccgctggtgatcaccgacgaagaaatcgcagacgcagtcaaggctattgccgagacaatcgcataaaggactcaaacttatgacttcacaaccacaggttcgccattttctggctgatgatgatctcacccctgcagagcaggcagaggttttgaccctagccgcaaagctcaaggcagcgccgttttcggagcgtccactcgagggaccaaagtccgttgcagttctttttgataagacttcaactcgtactcgcttctccttcgacgcgggcatcgctcatttgggtggacacgccatcgtcgtggattccggtagctcacagatgggtaagggcgagtccctgcaggacaccgcagctgtattgtcccgctacgtggaagcaattgtgtggcgcacctacgcacacagcaatttccacgccatggcggagacgtccactgtgccgctggtgaactccttgtccgatgatctgcacccatgccagattctggctgatctgcagactatcgtggaaaacctcagccctgaagaaggcccagcaggccttaagggtaagaaggctgtgtacctgggcgatggcgacaacaacatggccaactcctacatgattggctttgccaccgcgggcatggatatttccatcatcgctcctgaagggttccagcctcgtgcggaattcgtggagcgcgcggaaaagcgtggccaggaaaccggcgcgaaggttgttgtcaccgacagcctcgacgaggttgccggcgccgatgttgtcatcaccgatacctgggtatccatgggtatggaaaacgacggcatcgatcgcaccacacctttcgttccttaccaggtcaacgatgaggtcatggcgaaagctaacgacggcgccatcttcctgcactgccttcctgcctaccgtggcaaagaagtggcagcctccgtgattgatggaccagcgtccaaagttttcgatgaagcagaaaaccgcctccacgctcagaaagcactgctggtgtggctgctggccaaccagccgaggtaagacatgtcccttggctcaac

SEQ ID NO: 334 - protein, 319 aa, Corynebacterium glutamicum
MTSQPQVRHFLADDDLTPAEQAEVLTLAAKLKAAPFSERPLEGPKSVAVLFDKTSTRTRFSFDAGIAHLGGHAIVVDSGSSQMGKGESLQDTAAVLSRYVEAIVWRTYAHSNFHAMAETSTVPLVNSLSDDLHPCQILADLQTIVENLSPEEGPAGLKGKKAVYLGDGDNNMANSYMIGFATAGMDISIIAPEGFQPRAEFVERAEKRGQETGAKVVVTDSLDEVAGADVVITDTWVSMGMENDGIDRTTPFVPYQVNDEVMAKANDGAIFLHCLPAYRGKEVAASVIDGPASKVFDEAENRLHAQKALLVWLLANQPR

SEQ ID NO: 335 - DNA, 1326 bp, Corynebacterium glutamicum
  CDS (101)..(1303): RXA02160
ttttcgaggaataccaaccctttcaacacaataattttctttaaacatccttgctgtccaccacggctggcaaggaacttaaaatgaaggagcacacctcatgactaaccgcatcgttcttgcatactccggcggtctggacaccactgtggcaattccatacctgaagaagatgattgatggtgaagtcatcgcagtttccctcgacctgggccagggtggagagaacatggacaacgttcgccagcgtgcattggatgccggtgcagctgagtccatcgttgttgatgcaaaggatgagttcgctgaggagtactgcctgccaaccatcaaggcaaacggcatgtacatgaagcagtacccactggtttctgcaatctcccgcccactgatcgtcaagcacctcgttgaggctggcaagcagttcaacggtacccacgttgcacacggctgcactggtaagggcaacgaccaggttcgtttcgaggtcggcttcatggacaccgatccaaacctggagatcattgcacctgctcgtgacttcgcatggacccgcgacaaggctatcgccttcgccgaggagaacaacgttccaatcgagcagtccgtgaagtccccattctccatcgaccagaacgtctggggccgcgctattgagaccggttacctggaagatctgtggaatgctccaaccaaggacatctacgcatacaccgaggatccagctctgggtaacgctccagatgaggtcatcatctccttcgagggtggcaagccagtctccatcgatggccgtccagtctccgtactgcaggctattgaagagctgaaccgtcgtgcaggcgcacagggcgttggccgccttgacatggttgaggaccgtctcgtgggcatcaagtcccgcgaaatctacgaagcaccaggcgcaatcgcactgattaaggctcacgaggctttggaagatgtcaccatcgagcgcgaactggctcgctacaagcgcggcgttgacgcacgttgggctgaggaagtatacgacggcctgtggttcggacctctgaagcgctccctggacgcgttcattgattccacccaggagcacgtcaccggcgatatccgcatggttctgcacgcaggttccatcaccatcaatggtcgtcgttccagccactccctgtacgacttcaacctggctacctacgacaccggcgacaccttcgaccagaccctggctaagggctttgtccagctgcacggtctgtcctccaagatcgctaacaagcgcgatcgcgaagctggcaacaactaagccaccttttcaagcatcca

SEQ ID NO: 336 - protein, 401 aa, Corynebacterium glutamicum
MTNRIVLAYSGGLDTTVAIPYLKKMIDGEVIAVSLDLGQGGENMDNVRQRALDAGAAESIVVDAKDEFAEEYCLPTIKANGMYMKQYPLVSAISRPLIVKHLVEAGKQFNGTHVAHGCTGKGNDQVRFEVGFMDTDPNLEIIAPARDFAWTRDKAIAFAEENNVPIEQSVKSPFSIDQNVWGRAIETGYLEDLWNAPTKDIYAYTEDPALGNAPDEVIISFEGGKPVSIDGRPVSVLQAIEELNRRAGAQGVGRLDMVEDRLVGIKSREIYEAPGAIALIKAHEALEDVTIERELARYKRGVDARWAEEVYDGLWFGPLKRSLDAFIDSTQEHVTGDIRMVLHAGSITINGRRSSHSLYDFNLATYDTGDTFDQTLAKGFVQLHGLSSKIANKRDREAGNN

SEQ ID NO: 337 - DNA, 1554 bp, Corynebacterium glutamicum
  CDS (101)..(1531): RXN02162
gatcgctaacaagcgcgatcgcgaagctggcaacaactaagccaccttttcaagcatccagactagaacttcaagtatttagaaagtagaagaacaccacatggaacagcacggaaccaatgaaggtgcgctgtggggcggccgcttctccggtggaccctccgaggccatgttcgccttgagtgtctccactcatttcgactgggttttggccccttatgatgtgttggcctccaaggcacacgccaaggttttgcaccaagcagatctactttctgatgaagatctagccaccatgctggctgggcttgatcagctgggcaaggatgtcgccgacggaaccttcggtccgctgccttctgatgaggatgtgcacggcgcgatggaacgcggtgtgattgaccgcgttggtcctgaggtgggcggccgtctgcgcgctggtcgttcccgcaacgaccaggtggcaaccctgttccgcatgtgggtccgcgacgcagtgcgcgacatcgcgctgggaacaaccgagcttgtcgacgccctcagcgcccaagctaaggcacatgcaggcgcgatcatgccaggcaagacccacttccaggcagctcagccggtccttctggcacaccagctgctggcacacgcacagcctttgctgcgcgatattgatcgtatccgtgacctggacaagcgtcttgcggtgtctccttacggttccggcgcacttgctggttcctctttgaagctcaaccctgaagcaatcgctgaagaactcggctttgattccgcagcagataactccattgatgccaccagctcccgcgatttcgcatctgaaaccgccttcgtgctggcgcagcttgcagtggatatgtcccgcttggctgaagaaatcatcgcatggtgcaccccagaatttggttacatcaccttgtctgattcctggtccacaggcagctcaatcatgccgcagaagaagaaccctgacgtggcagagctgacccgtggcaagtctggtcgcttgatcggtaacctcaccggtctgctggctaccctgaaggcacagcctttagcgtacaaccgcgacctgcaggaagataaggaaccaatcgtagattccgtggcgcagctcaacctgctgctccctgcaatgactggtttggtttccaccttgaccttcaacaccgagcgcatgcgtgaacttgcaccagcaggtttcacccttgccaccgacttggctgagtggatggtgcgccagggcgttccattccgtgaggcacacgaagcatccggcgcttgcgtgcggatcgcggagtccaggggagtggaccttatcgatctcactgatgaagaactcagtggcgttgatgcacgtctgaccccagaggtacgggaagtgctcaccattgatggtgcagtggcttcccgtgcaacgcgcggtggaaccgcgggcgtgcgggttgcggagcaacgcgcacgtgtcgatgccgcaagtaccgctcacgcggagtgggcacgtgcgggggtacgtcgataagcattagtttatggcctgtg

SEQ ID NO: 338 - protein, 477 aa, Corynebacterium glutamicum
MEQHGTNEGALWGGRFSGGPSEAMFALSVSTHFDWVLAPYDVLASKAHAKVLHQADLLSDEDLATMLAGLDQLGKDVADGTFGPLPSDEDVHGAMERGVIDRVGPEVGGRLRAGRSRNDQVATLFRMWVRDAVRDIALGTTELVDALSAQAKAHAGAIMPGKTHFQAAQPVLLAHQLLAHAQPLLRDIDRIRDLDKRLAVSPYGSGALAGSSLKLNPEAIAEELGFDSAADNSIDATSSRDFASETAFVLAQLAVDMSRLAEEIIAWCTPEFGYITLSDSWSTGSSIMPQKKNPDVAELTRGKSGRLIGNLTGLLATLKAQPLAYNRDLQEDKEPIVDSVAQLNLLLPAMTGLVSTLTFNTERMRELAPAGFTLATDLAEWMVRQGVPFREAHEASGACVRIAESRGVDLIDLTDEELSGVDARLTPEVREVLTIDGAVASRATRGGTAGVRVAEQRARVDAASTAHAEWARAGVRR

SEQ ID NO: 339 - DNA, 906 bp, Corynebacterium glutamicum
  CDS (101)..(883): FRXA02161
  misc_feature 863: n = a, g, c, or t
  VARIANT 255: Xaa = Gly, Ser, Arg, or Cys
gatcgctaacaagcgcgatcgcgaagctggcaacaactaagccaccttttcaagcatccagactagaacttcaagtatttagaaagtagaagaacaccacatggaacagcacggaaccaatgaaggtgcgctgtggggcggccgcttctccggtggaccctccgaggccatgttcgccttgagtgtctccactcatttcgactgggttttggccccttatgatgtgttggcctccaaggcacacgccaaggttttgcaccaagcagatctactttctgatgaagatctagccaccatgctggctgggcttgatcagctgggcaaggatgtcgccgacggaaccttcggtccgctgccttctgatgaggatgtgcacggcgcgatggaacgcggtgtgattgaccgcgttggtcctgaggtgggcggccgtctgcgcgctggtcgttcccgcaacgaccaggtggcaaccctgttccgcatgtgggtccgcgacgcagtgcgcgacatcgcgctgggaacaaccgagcttgtcgacgccctcagcgcccaagctaaggcacatgcaggcgcgatcatgccaggcaagacccacttccaggcagctcagccggtccttctggcacaccagctgctggcacacgcacagcctttgctgcgcgatattgatcgtatccgtgacctggacaagcgtcttgcggtgtctccttacggttccggcgcacttgctggttcctctttgaagctcaaccctgaagcaatcgctgaagaactcggctttgattccgcagcagataactccattgatgccaccagctcccgcgatttcgcatctgaaaccgccttcgtgctggcgcagcttgcangtggatatgtcccgcttggctgaagaaatcatcgcatggtgca

SEQ ID NO: 340 - protein, 261 aa, Corynebacterium glutamicum
  VARIANT 255: Xaa = Gly, Ser, Arg, or Cys
MEQHGTNEGALWGGRFSGGPSEAMFALSVSTHFDWVLAPYDVLASKAHAKVLHQADLLSDEDLATMLAGLDQLGKDVADGTFGPLPSDEDVHGAMERGVIDRVGPEVGGRLRAGRSRNDQVATLFRMWVRDAVRDIALGTTELVDALSAQAKAHAGAIMPGKTHFQAAQPVLLAHQLLAHAQPLLRDIDRIRDLDKRLAVSPYGSGALAGSSLKLNPEAIAEELGFDSAADNSIDATSSRDFASETAFVLAQLAXGYVPLG

SEQ ID NO: 341 - DNA, 786 bp, Corynebacterium glutamicum
  CDS (101)..(763): FRXA02162
  misc_feature 94: n = a, g, c, or t
ctcggctttgattccgcagcagataactccattgatgccaccagctcccgcgatttcgcatctgaaaccgccttcgtgctggcgcagcttgcangtggatatgtcccgcttggctgaagaaatcatcgcatggtgcaccccagaatttggttacatcaccttgtctgattcctggtccacaggcagctcaatcatgccgcagaagaagaaccctgacgtggcagagctgacccgtggcaagtctggtcgcttgatcggtaacctcaccggtctgctggctaccctgaaggcacagcctttagcgtacaaccgcgacctgcaggaagataaggaaccaatcgtagattccgtggcgcagctcaacctgctgctccctgcaatgactggtttggtttccaccttgaccttcaacaccgagcgcatgcgtgaacttgcaccagcaggtttcacccttgccaccgacttggctgagtggatggtgcgccagggcgttccattccgtgaggcacacgaagcatccggcgcttgcgtgcggatcgcggagtccaggggagtggaccttatcgatctcactgatgaagaactcagtggcgttgatgcacgtctgaccccagaggtacgggaagtgctcaccattgatggtgcagtggcttcccgtgcaacgcgcggtggaaccgcgggcgtgcgggttgcggagcaacgcgcacgtgtcgatgccgcaagtaccgctcacgcggagtgggcacgtgcgggggtacgtcgataagcattagtttatggcctgtg

SEQ ID NO: 342 - protein, 221 aa, Corynebacterium glutamicum
MSRLAEEIIAWCTPEFGYITLSDSWSTGSSIMPQKKNPDVAELTRGKSGRLIGNLTGLLATLKAQPLAYNRDLQEDKEPIVDSVAQLNLLLPAMTGLVSTLTFNTERMRELAPAGFTLATDLAEWMVRQGVPFREAHEASGACVRIAESRGVDLIDLTDEELSGVDARLTPEVREVLTIDGAVASRATRGGTAGVRVAEQRARVDAASTAHAEWARAGVRR

SEQ ID NO: 343 - DNA, 1269 bp, Corynebacterium glutamicum; identical to SEQ ID NO: 301
  CDS (101)..(1246): RXA02262

SEQ ID NO: 344 - protein, 382 aa, Corynebacterium glutamicum; identical to SEQ ID NO: 302

SEQ ID NO: 345 - DNA, 1065 bp, Corynebacterium glutamicum
  CDS (101)..(1042): RXA00219
tttgccgtacatgcgcgagcacctcctcaacagcccgcaccaccgaccaatcacataagacacaagcactaaaacagcattaaagaaagaaagctttttcgtggcccgtaagaaaaacacgtccgatcaatcccgctcccaagctgccaacacgcccattgctggcacctatgagggtgaatattccgtcatcgagttggaggccgattcctacaccaccgatggctggttgatcagcattaatggcgtgcccagctctcatattgtcctggggcaaccgcaggcactggaatttgagtacatgcggtggatcgctaccggcgctcgggcgttcatcgatgcgcatcaggatgcatccaagctgcggattactcacctcggcggcggtgcgtgcacgatggccaggtatttcgcggatgtttacccgcagtcacgcaacactgtcgtggaattggatgcagagcttgcccgcctgtcgcgtgaatggttcgacattccgcgcgcgccacgggtaaagattcgtgtggatgatgcccgaatggtggcagaatctttcactcccgcaagccgcgatgtgatcatccgtgacgtttttgccggagctatcacgccgcagaacttcaccaccgtggagttctttgagcactgtcaccgtggccttgctcccggcggattgtacgttgccaactgtggcgatcattcggatctgcgcggagctaaatctgagctcgcgggaatgatggaggtgttcgagcacgtcgcggtcatcgccgatcccccgatgcttaaagggcgccgttacggcaacatcattttgatgggttcagacaccgagttctttagctccaacagcacggaagcgtccgcgattacccgtgagcttcttggcggcggcgttccagcgcagtacaaggatgaatcctgggtgcggaaattcgcctcgggagcccaggcccgccacgatggggtctctaccctccaaatgccgagtgatactccacaacaccctgcggaaacgccggagcattcaaacacacagccataaaaaattccgctggcgcgtcc

SEQ ID NO: 346 - protein, 314 aa, Corynebacterium glutamicum
VARKKNTSDQSRSQAANTPIAGTYEGEYSVIELEADSYTTDGWLISINGVPSSHIVLGQPQALEFEYMRWIATGARAFIDAHQDASKLRITHLGGGACTMARYFADVYPQSRNTVVELDAELARLSREWFDIPRAPRVKIRVDDARMVAESFTPASRDVIIRDVFAGAITPQNFTTVEFFEHCHRGLAPGGLYVANCGDHSDLRGAKSELAGMMEVFEHVAVIADPPMLKGRRYGNIILMGSDTEFFSSNSTEASAITRELLGGGVPAQYKDESWVRKFASGAQARHDGVSTLQMPSDTPQHPAETPEHSNTQP

SEQ ID NO: 347 - DNA, 1662 bp, Corynebacterium glutamicum
  CDS (101)..(1639): RXA01508
ttccgggacgtttccgtgatctcgtggaagatcccaaactccgttccggtgccgtcgtggccgccgtcatcttgatcgtggtgggaaccgtaaacgctgcatgtctgatttaggacccatctggcgctggctgttattagtttccgtctccatttgtgcggcatcggggctggtctatgagctagccctggtatcgctttccaccagcttgaacggtggcggaattgtagaaacctccctcatcgtcgcaggttatgtagctgcccttggacttggtgcactgctggtcaagccgtttctcaactggcctgcgcaaaccttcctcggtgtggaaaccctccttggacttattggtggttgttccgcgctggtgctgtatttcaccttcgcgaccatcggccaatccctgtggattctggtgattgccaccgctgcaattggcatcctggtcggcgctgaacttccactgctgatgaccatgatccagcaaggccgcctcgccgacgccaaaaccacaggatctctggttgccaccttgaatgctgctgattaccttggcgcacttttaggtggcctggcctggccttttgtgttgctgccgtggcttggcatgatgcgcggtgccgcagcagccggaatgatcaacctcgttgcagcactattcgtgggctgtgtgctgctgcgacatttgcttccgcgcacccacttcttcgtatccgtggtggcgcttcttctcgcgatcgcagcgctagccaccgtgttggtgaaatccgacgggatcgttgccaccgcccgcgcacagctctaccgcgaccccgtgatctattcacaccaatctgactaccaagacatcgtagtgacagaacgaggcaaagaccgacgcctctacctcaatggcggtttgcagtattccactcgtgaccagcatagatatacagaatcactggtgtatccaagccttaatccagaggcagaatcggtgttaatcatcggcggtggcgatggcctcgcagcacgggaactcctccgattcccatcaatgcagatcacccaagttgaattagacccagaagtcatcgaagtagccaacacagtgctgcgctctgacaatgggggagcgatggaagatccccgcgtctccatcatcgttgacgacgctttcacctggctgcgctccggcggaaataatggcgaaacttacgattccatcatcatcgatcttcccgacccaaacaacgacaccatggccaggctgtattcagaagagttctacaccttggcccgagcacgactgaacgaacaaggccgcatggtggtgcaatcctccagcgcctacaccactccagatgtgttctggcgagttggagcaaccttgaaatcggcgggctgtgaacaagtcatcccatatcacgtgcatgttcccacatttggcgactggggcttccaactgtgtggccctgccgacatggaattagagcttcgggaagacaccccgccactgactttccttaatgatgaagttctggtggctgctggggtgtttgggttggataatcagcctcgtgaattggaaccttccacgctggatcatccccgcgtggtggaggatctgcgcaagggataccgcgaatcaggcgactagctgcaacgatgcgctgtgtg

SEQ ID NO: 348 - protein, 513 aa, Corynebacterium glutamicum
MSDLGPIWRWLLLVSVSICAASGLVYELALVSLSTSLNGGGIVETSLIVAGYVAALGLGALLVKPFLNWPAQTFLGVETLLGLIGGCSALVLYFTFATIGQSLWILVIATAAIGILVGAELPLLMTMIQQGRLADAKTTGSLVATLNAADYLGALLGGLAWPFVLLPWLGMMRGAAAAGMINLVAALFVGCVLLRHLLPRTHFFVSVVALLLAIAALATVLVKSDGIVATARAQLYRDPVIYSHQSDYQDIVVTERGKDRRLYLNGGLQYSTRDQHRYTESLVYPSLNPEAESVLIIGGGDGLAARELLRFPSMQITQVELDPEVIEVANTVLRSDNGGAMEDPRVSIIVDDAFTWLRSGGNNGETYDSIIIDLPDPNNDTMARLYSEEFYTLARARLNEQGRMVVQSSSAYTTPDVFWRVGATLKSAGCEQVIPYHVHVPTFGDWGFQLCGPADMELELREDTPPLTFLNDEVLVAAGVFGLDNQPRELEPSTLDHPRVVEDLRKGYRESGD

SEQ ID NO: 349 - DNA, 924 bp, Corynebacterium glutamicum
  CDS (101)..(901): RXA01757
cgcttattgaacggatgcctctcgatcaagccaacgaggctattgcacgtatttcagctggtaaaccacgtttccgtattgtcttggagccgaattcataatgccaacagcaagcccaatttatgatgtcgttgtcgtcggagccggcatttctggcctcatcgccacgcaactgttggaccgcgcaggtctaaacatcaaatgcttcgaagcctgctcaagagttggcggccgagcagtgtctgtccaacagtccgatttgttcctggacctcggcgcaacatggttctggctcaacgaaccacttgtgcagcaactcgtcaataatctcggcctcggcacattccctcaggccatcgagggtgatgcgctttttgagacgcttgtcgacgccccgagccgcctgcggggtaaccccatagacgctgcttcaggcaggttccaagcaggggcctcctcgcttgcgctcgggcttgcagcccagctcaagccaggagttttagaactcggggaccccgtccattctctcagtgaggaagatggggaaatcgttgtgaagtcttccaaacagattgtgagggcaaagcacgtcatcattgcggttccaccggcactcgctgccgagttgattggtttcaccctagatttaccagctgacgtgcgaaaagcagcgcatccacaacatatagctgtgatgaattgggcaaaggagaaatacaccttacccacacaagccgcatcggctgggggttttgggcatgagctgttccaacaaccactcggacatgggcgaattcattgggcatcaacggaagttgccactgagtttggtggacaccttgaaggcgcagttcgtgcaggaattcaggctgcgcttcaaacaggatttaatctaaaatcttaaacctcgtattttccctgata

SEQ ID NO: 350 - protein, 267 aa, Corynebacterium glutamicum
MPTASPIYDVVVVGAGISGLIATQLLDRAGLNIKCFEACSRVGGRAVSVQQSDLFLDLGATWFWLNEPLVQQLVNNLGLGTFPQAIEGDALFETLVDAPSRLRGNPIDAASGRFQAGASSLALGLAAQLKPGVLELGDPVHSLSEEDGEIVVKSSKQIVRAKHVIIAVPPALAAELIGFTLDLPADVRKAAHPQHIAVMNWAKEKYTLPTQAASAGGFGHELFQQPLGHGRIHWASTEVATEFGGHLEGAVRAGIQAALQTGFNLKS

SEQ ID NO: 351 - DNA, 636 bp, Corynebacterium glutamicum
  CDS (101)..(613): RXA02159
tgatggaccagcgtccaaagttttcgatgaagcagaaaaccgcctccacgctcagaaagcactgctggtgtggctgctggccaaccagccgaggtaagacatgtcccttggctcaaccccgtcaacaccggaaaacttaaatcccgtgactcgcactgcacgccaagctctcattttgcagattttggacaaacaaaaagtcaccagccaggtacaactgtctgaattgctgctggatgaaggcatcgatatcacccaggccaccttgtcccgagatctcgatgaactcggtgcacgcaaggttcgccccgatgggggacgcgcctactacgcggtcggcccagtagatagcatcgcccgcgaagatctccggggtccgtcggagaagctgcgccgcatgcttgatgaactgctggtttctacagatcattccggcaacatcgcgatgctgcgcaccccgccgggagctgcccagtacctggcaagtttcatcgatagggtggggctgaaagaagtcgttggcaccatcgctggtgatgacaccgttttcgttctcgcccgtgatccgctcacaggtaaagaactaggtgaattactcagcgggcgcaccacttaaagcgcccctagttcaaggct

SEQ ID NO: 352 - protein, 171 aa, Corynebacterium glutamicum
MSLGSTPSTPENLNPVTRTARQALILQILDKQKVTSQVQLSELLLDEGIDITQATLSRDLDELGARKVRPDGGRAYYAVGPVDSIAREDLRGPSEKLRRMLDELLVSTDHSGNIAMLRTPPGAAQYLASFIDRVGLKEVVGTIAGDDTVFVLARDPLTGKELGELLSGRTT

SEQ ID NO: 353 - DNA, 414 bp, Corynebacterium glutamicum; identical to SEQ ID NO: 325
  CDS (101)..(391): RXN02154

SEQ ID NO: 354 - protein, 97 aa, Corynebacterium glutamicum; identical to SEQ ID NO: 326

SEQ ID NO: 355 - DNA, 1302 bp, Corynebacterium glutamicum
  CDS (101)..(1279): RXS00147
attgcatataatgcaatgaattgaataaactacattcagggttatcaaccagccaatttcttttaaaaaggcagacacacgaaaggcgacaacagtcaccgtgagtaaagacaccaccacctaccagggagtcaccgagatcggatccgttccggcatacctggttcttgcagacggacgtaccttcaccggatttggctttggagctatcggcaccacccttggtgaggcagtgttcactaccgccatgaccggttaccaagaaaccatgaccgatccttcctatcaccgccagattgttgtggctaccgcaccacagatcggcaacaccggctggaacgatgaggacaacgagtcccgcgacggcaagatttgggttgcaggccttgttatccgcgacctcgcagcacgtgtgtccaactggcgcgccaccacctccttgcagcaggaaatggcaggccagggcatcgtcggcatcggcggaatcgacacccgcgcactggttcgccacctgcgcaatgaaggttccattgcagcgggcatcttctccggcgctgacgcacagcgcccagttgaagaactcgtagagatcgtcaagaatcagccagcaatgaccggcgcaaacctctccgttgaggtctctgctgatgaaacctacgtcatcgaagctgaaggcgaagagcgccacaccgtcgtggcctacgacctgggcattaagcaaaacaccccacgtcgtttctctgcacgcggtgttcgcaccgtcatcgtgcctgctgaaaccccattcgaggatatcaagcagtacaacccatcaggcgtgttcatctccaacggccctggcgatcctgcagcagcagacgtcatggttgatatcgtccgcgaagttcttgaagccgacattccattctttggcatctgcttcggcaaccagattcttggccgcgcattcggcatggagacctacaagctgaagttcggccaccgcggcatcaacgttccagtgaagaaccacatcaccggcaagatcgacatcaccgcccagaaccacggcttcgcactcaagggtgaagcaggccaggaattcgagaccgatttcggcactgcaattgtcacccacacctgcctcaacgacggcgtcgttgaaggtattgcgctgaagtccggacgcgcatactccgttcagtaccacccagaggccgctgccggcccaaatgatgcaagccccctgtttgaccagtttgttgagctgatggatgcagacgctcagaagaaaggcgcataaataacatgccaaagcgttca

SEQ ID NO: 356 - protein, 393 aa, Corynebacterium glutamicum
VSKDTTTYQGVTEIGSVPAYLVLADGRTFTGFGFGAIGTTLGEAVFTTAMTGYQETMTDPSYHRQIVVATAPQIGNTGWNDEDNESRDGKIWVAGLVIRDLAARVSNWRATTSLQQEMAGQGIVGIGGIDTRALVRHLRNEGSIAAGIFSGADAQRPVEELVEIVKNQPAMTGANLSVEVSADETYVIEAEGEERHTVVAYDLGIKQNTPRRFSARGVRTVIVPAETPFEDIKQYNPSGVFISNGPGDPAAADVMVDIVREVLEADIPFFGICFGNQILGRAFGMETYKLKFGHRGINVPVKNHITGKIDITAQNHGFALKGEAGQEFETDFGTAIVTHTCLNDGVVEGIALKSGRAYSVQYHPEAAAGPNDASPLFDQFVELMDADAQKKGA

SEQ ID NO: 357 - DNA, 924 bp, Corynebacterium glutamicum
  CDS (101)..(901): RXS00905
cgctgcccctctatgctgctcctagttacccctgcacaaatagcggtttttctcacgcattctgcatcgagtcgggtcgacgtatataaggtggaaaggcatgacccaattcgaaaacgcgcaagtacttaaagagaacatcgaaaaccaacgcgagcagatctttacccagttgaaagaaattgtgtctttcaactccgtgcacagcgatccaaacctactggaggactacgccggcgcgaaagaatgggtaaaagaaacactgaccaacgcaggtctcaccgtcagcgaattcgctgccgaagatggaaccaccaacttcatcggcacccgcaagggctccgaaggtgcaccaaaggtactgctgtacagccacttcgacgttgtcccatccggccctttggatctctgggacaccaatccttttgaactcaccgagcgcgacgctggccacggcacccgctggtacggccgcggcgccgctgactgcaagggcaacctggtcatgcacctcgcagcactgcgcgccgtcgaagccagcggcgacaccacactcaacctcacctacgtggtcgagggctccgaggaaatgggaggcggagcgctcagcgcgctcatcaaggacaagcctgagcttttcgacgcagatgtcatcttgattgcagacagcggaaacgcttccgtgggcaccccaaccttgaccactaccctgcgcggtggcggacaggtcaccgtcaccgtggacacccttgaaggcgctgttcactccggccagaacggtggcgctgccccagatgctgttgctgctctcgtgcgcgttctggatactttgcgcgatgaacacggacgcaccgttatcgacggctgtcaacaccaccgcaaactggaagggcgagccttatgatccagagactttccgcagcg

SEQ ID NO: 358 - protein, 267 aa, Corynebacterium glutamicum
MTQFENAQVLKENIENQREQIFTQLKEIVSFNSVHSDPNLLEDYAGAKEWVKETLTNAGLTVSEFAAEDGTTNFIGTRKGSEGAPKVLLYSHFDVVPSGPLDLWDTNPFELTERDAGHGTRWYGRGAADCKGNLVMHLAALRAVEASGDTTLNLTYVVEGSEEMGGGALSALIKDKPELFDADVILIADSGNASVGTPTLTTTLRGGGQVTVTVDTLEGAVHSGQNGGAAPDAVAALVRVLDTLRDEHGRTVIDGCQHHRKLEGRAL

SEQ ID NO: 359 - DNA, 627 bp, Corynebacterium glutamicum
  CDS (101)..(604): RXS00906
accgtggacacccttgaaggcgctgttcactccggccagaacggtggcgctgccccagatgctgttgctgctctcgtgcgcgttctggatactttgcgcgatgaacacggacgcaccgttatcgacggctgtcaacaccaccgcaaactggaagggcgagccttatgatccagagactttccgcagcgatgccggcatcctcgacggtgtagacatcatgggcgacggcgacaacccagcaagcatgctgtggtccaggcctgcaatctccatcaccggattcacttccaccccagtggcagaagcactcaacgcagtgcccgcaacggcgtccgccaagctaaaccttcgcgtgccagcaggcctggaagcaaacgatgtggccgagaagctgaagcagcacctgatcaatcacacaccttggggcgcaaagatcacggtggagatcgatgacattaaccaaccgttctccaccgatattaccggccctgcaatgtccaccctggcgtcctgcctgagcgctgcgtacgagggcaaggatcttgtcaccgaaggcagcggcggatccattccactgtgtaccgaactgattgaggtcaacccataagcagaattggcactctacgg

SEQ ID NO: 360 - protein, 168 aa, Corynebacterium glutamicum
MNTDAPLSTAVNTTANWKGEPYDPETFRSDAGILDGVDIMGDGDNPASMLWSRPAISITGFTSTPVAEALNAVPATASAKLNLRVPAGLEANDVAEKLKQHLINHTPWGAKITVEIDDINQPFSTDITGPAMSTLASCLSAAYEGKDLVTEGSGGSIPLCTELIEVNP

SEQ ID NO: 361 - DNA, 246 bp, Corynebacterium glutamicum
  CDS (101)..(223): RXS00907
cctgagcgctgcgtacgagggcaaggatcttgtcaccgaaggcagcggcggatccattccactgtgtaccgaactgattgaggtcaacccataagcagaattggcactctacggtgtggaagaacccctcaccgttatccactccgctaatgaatctgttgaccccaatgagattcgcgatatcgccaccgcagaagcattgttcctgctcaactacaccaagtagacccaaaagcaggcgttaac

SEQ ID NO: 362 - protein, 41 aa, Corynebacterium glutamicum
LALYGVEEPLTVIHSANESVDPNEIRDIATAEALFLLNYTK

SEQ ID NO: 363 - DNA, 1281 bp, Corynebacterium glutamicum
  CDS (101)..(1258): RXS02001
gcggtttcgtcatggataaggactgtgttcgggaccattgcgatactcgtgtcaaaaggcgatagtccagcatagaccgtgctttatcgaaggtgaacccatgcccgttatcaatagtatcgccagtttttccgacgagatgacccgctggcggcgtcacctgcatcaaaaccccgaaatcagctttgattgtgtggaaactgcggccttcgtggccgagcagctgcgcagcttcggggtggatgaaattcacaccggcatcgcgaaaaccggtatcatcgccctgattcacgggcgcgaggctggccccgtcgtcggcctgcgcgccgatatggacgcgctgccgctgaccgagattaccggcgtcgactatgcctcgaccacccccggaaaaatgcacgcctgcggccacgacggccacacgaccatgctgctgggcgccgccaaatatctggccgagacgcgcaatttcgcaggtaccgtcgcgctgatcttccagcctgcggaagaaaacggcggcggcgcgggcgttatggtcgatgaaggcgtcctcgaccgctttgccatcgccgaagtctacgccctgcacaaccagcccggcctgccgcttggccattttatgacgacagccggcccgatcatggccgctgtcgacacgttcgacatcaacattaccggacgcggcggccacggtgccaaaccgcaccaaacccgcgaccccatcgtcgcagccgtcggaattgtccaagcgtttcaaacgatagtcagccggaatcacaatccggtcgaggaccttgtcgtgtcggtcacgcaaatccacaccggcagcgccgataatatcatccccgaaaccgcctatatcaacggcactgtccgcaccttcaacaaagacgtgcaggccatggtcatcacgcggatggaagaaatcgtcgcgggccaagctgcagcctatggggtcgaggcgacgctgacctacaaccgcaactatcccgccaccattaacgacgccgccaaagccgccatcgctgccgaagtcgcgggcgaggtcggcctcggggtcaacccgaacggctcgcgcgggatgggggccgaggatttctcgtatttcctcgaaaagcgcccgggtgcctacctgttcgtcggtaatggcgacagcgcgggccttcacaaccccgcctataatttcaacgacgaggccgcgccctacggcgcatcgttcttggcccgcatggcagaacgccccttgccgttaaagggctgatccatggcgctcgaagatgc

SEQ ID NO: 364 - protein, 386 aa, Corynebacterium glutamicum
MPVINSIASFSDEMTRWRRHLHQNPEISFDCVETAAFVAEQLRSFGVDEIHTGIAKTGIIALIHGREAGPVVGLRADMDALPLTEITGVDYASTTPGKMHACGHDGHTTMLLGAAKYLAETRNFAGTVALIFQPAEENGGGAGVMVDEGVLDRFAIAEVYALHNQPGLPLGHFMTTAGPIMAAVDTFDINITGRGGHGAKPHQTRDPIVAAVGIVQAFQTIVSRNHNPVEDLVVSVTQIHTGSADNIIPETAYINGTVRTFNKDVQAMVITRMEEIVAGQAAAYGVEATLTYNRNYPATINDAAKAAIAAEVAGEVGLGVNPNGSRGMGAEDFSYFLEKRPGAYLFVGNGDSAGLHNPAYNFNDEAAPYGASFLARMAERPLPLKG

SEQ ID NO: 365 - DNA, 1386 bp, Corynebacterium glutamicum
  CDS (101)..(1363): RXS02101
gccatggaatgctccgttgaacgcaacagccttaaatacaatcccctcctataagccaagagttttagtgtcgctgcgcaggtactctactatctaatccatgagccgcatttcagaacttctaaacaatcatggtgttgatctgtcgtggcaagaggccgcatatcaggatttccacgaacatcctgagctctccggcttcgaatcagagaccgcagatcgcattcagaaatacctcgagcgttttgattgtgaggtgattccaaatgttggcggttacggcattctggccgtgttccgaaatgggtcgacagatcctggtgcccctgttgcgttaatgcgcgcagatttcgatggccttcccgtcaaggaaatcaccggagttccgtttgcttccactcgtatgcgtccgcatgatggggcaaatgtccatgtcatgcacgcatgcggccacgatgtccacgtcaccgcgctgcttggtgcgtgtgccattttagatgagcgtcgcgatgcatgggaaggcacgttcatcgcgttgttccagccatcggaggaaaactcccaaggcgctaacaagatggtcgccggcggtttagttgatctgatcccacgccctgatgtgtgctttggccagcatgtagtccccggtgctgcaggaaccgtgatgagcatgcctggcggtgctctcgctgcctgcgattccattgaaatccgcattcagggtcgcagcgcccatggttccatgcctcataattccatcgatcccacttatgttgcagcgatgattgtcgtgcgactccaaggaatcgtgggccgcgaggtttctccagaggatttcgccgttatttctgtgggcaccctccagtcgggcaacaccaacaacaccattccagcaagtgctcgtttggtgttgaactgccgtttctacaacgacaaagtcaagcacaaggtctaccgagccatcgaacgtgttgtccgtggtgaatgccttgcttccggtattgaggaagaacctgtcattgagtacttcgcccacggtgatctcaccaacaacacccctgttgtcttcgatactgtgcgccctgtcttcgacgatgttttcggcgaggattctattgacgcttaccggtggactgcgtcggaggatttcccctccattcctaaggcattcaacagcccttacctgtactggacgattggtgtcacgccgcgcgatcagtggacagaagccgtagaaagagaccgcgtggcatcggatgtgccagccaatcacatgggagatttcctccctgattatgcgccgacgatgtccgctgccacccgcgcagccgcagccgcgctgctgacctacttgggaactaactaatcatctagttttctgcgacg

SEQ ID NO: 366 - protein, 421 aa, Corynebacterium glutamicum
MSRISELLNNHGVDLSWQEAAYQDFHEHPELSGFESETADRIQKYLERFDCEVIPNVGGYGILAVFRNGSTDPGAPVALMRADFDGLPVKEITGVPFASTRMRPHDGANVHVMHACGHDVHVTALLGACAILDERRDAWEGTFIALFQPSEENSQGANKMVAGGLVDLIPRPDVCFGQHVVPGAAGTVMSMPGGALAACDSIEIRIQGRSAHGSMPHNSIDPTYVAAMIVVRLQGIVGREVSPEDFAVISVGTLQSGNTNNTIPASARLVLNCRFYNDKVKHKVYRAIERVVRGECLASGIEEEPVIEYFAHGDLTNNTPVVFDTVRPVFDDVFGEDSIDAYRWTASEDFPSIPKAFNSPYLYWTIGVTPRDQWTEAVERDRVASDVPANHMGDFLPDYAPTMSAATRAAAAALLTYLGTN

SEQ ID NO: 367 - DNA, 3462 bp, Corynebacterium glutamicum
  CDS (101)..(3439): RXS02234
acccagaggccgctgccggcccaaatgatgcaagccccctgtttgaccagtttgttgagctgatggatgcagacgctcagaagaaaggcgcataaataacatgccaaagcgttcagatattaaccacgtcctcgtcatcggttccggccccatcgtcattggccaggcatgtgaattcgactactccggcacccaggcttgccgcgtgctgaaggaagagggactgcgcgtcaccctcatcaactccaacccagcaacgatcatgaccgacccagaaatggctgaccacacctacgtggagccaatcgagccggaatacatcgacaagattttcgctaaggaaatcgagcagggccacccaatcgacgccgtcctggcaacccttggtggccagactgcacttaacgcagctatccagctggatcgcctcggcatcctggaaaagtacggcgttgaactcatcggtgcagacatcgatgccattgagcgcggcgaagatcgccagaagttcaaggatattgtcaccaccatcggtggcgaatccgcgcgttcccgcgtctgccacaacatggaagaagtccacgagactgtcgcagaactcggccttccagtagtcgtgcgtccatccttcactatgggtggcctgggctccggtcttgcatacaacaccgaagaccttgagcgcatcgctggtggcggacttgctgcatctcctgaagcaaacgtcttgatcgaagaatccatccttggttggaaggaattcgagctcgagctcatgcgcgataccgcagacaacgttgtggttatctgctccattgaaaacgtcgacgcactgggcgtgcacaccggcgactctgtcaccgtggcacctgccctgaccctgactgaccgtgaattccagaagatgcgcgatcagggtatcgccatcatccgcgaggtcggcgtggacaccggtggatgtaacatccagttcgccatcaacccagttgatggccgcatcatcaccattgagatgaacccacgtgtgtctcgttcctccgctctggcatccaaggcaacgggcttcccaattgccaagatggctgccaagctggctatcggatacaccctggatgagatcaccaacgacatcactggtgaaaccccagctgcgtttgagcccaccatcgactacgtcgtggtcaaggccccacgctttgctttcgagaagtttgtcggcgctgatgacactttgaccaccaccatgaagtccgtcggtgaggtcatgtccctgggccgcaactacattgcagcactgaacaaggcactgcgttccctggaaaccaagcagcagggtttctggaccaagcctgatgagttcttcgcaggggagcgcgctaccgataaggcagctgttctggaagatctcaagcgcccaaccgaaggccgcctctacgacgttgagctggcaatgcgccttggcgcaagcgtggaagaactctacgaagcatcttctattgatccttggttcctcgccgagcttgaagctctcgtgcagttccgccagaagctcgttgacgcaccattcctaaacgaagatctcctgcgcgaagcaaagttcatgggtctgtccgacctgcagatcgcagcccttcgcccagagttcgctggcgaagacggcgtacgcaccttgcgtctgtccctaggcatccgcccagtattcaagactgtggatacctgtgcagcagagtttgaagctaagactccgtaccactactccgcatacgagctggatccagcagctgagtctgaggtcgcaccacagactgagcgtgaaaaggtcctgatcttgggctccggtccaaaccgcatcggccagggcatcgagttcgactactcctgtgttcacgcagctcttgagctctcccgcgtcggctacgaaactgtcatggtcaactgcaacccagagaccgtgtccaccgactacgacaccgctgaccgcctgtacttcgagccactgaccttcgaagacgtcatggaggtctaccacgctgaggcgcagtccggcaccgtcgcaggtgttatcgtccagcttggtggccagactcctctgggcttggcagatcgtttgaagaaggctggcgtccctgtcattggtacctccccagaggcaatcgacatggctgaggaccgtggcgagttcggtgcactgctgaaccgcgagcagcttcctgctccagcattcggcaccgcaacctctttcgaagaggctcgcacagtagccgatgagatcagctacccagtgctggttcgcccttcctacgtcttgggtggccgtggcatggagattgtctacgatgaggcttccctcgaggattacatcaaccgcgcaactgagttgtcttctgaccacccagtgctggttgaccgcttcctagacaacgctattgagatcgacgtcgacgcactgtgcgacggcgacgaggtctacctggcaggcgtcatggagcacatcgaggaagccggcattcactccggtgactccgcatgtgcacttcctccaatgactttgggcgcacaggacatcgagaaggtccgcgaagcaaccaagaagctggctctgggcatcggtgtacagggcctgatgaacgtccagtacgcactcaaggacgacatcctctacgtcatcgaggcaaacccacgtgcatcccgcaccgtgccgttcgtctccaaggcaacgggcgtcaacctggccaaggcagcatcccgtatcgcagtgggcgccaccatcaaggatctccaagatgagggcatgattcctaccgagtacgacggcggctccttgccactggacgctccaatcgctgtgaaggaagcagtgttgccgttcaaccgcttccgtcgcccagatggaaagaccctggacaccctgctttccccagagatgaagtccactggcgaggtcatgggcttggccaacaacttcggcgctgcatatgcaaaggctgaagctggcgcgtttggtgcattgccaaccgaaggcaccgtcttcgtgaccgtggctaaccgcgacaagcgcaccctgatcctgccaatccagcgcctggcgttgatgggctacaagatcctcgccaccgaaggcaccgcaggcatgctgcgccgcaacggcattgagtgtgaagttgtgctcaaggcttccgacatccgcgaaggtgtagagggcaagtccatcgtggatcgtatccgcgaaggcgaagttgacctcatcctcaacaccccagctggttctgctggcgctcgccacgatggctacgatatccgcgcagcagcagtgaccgtgggtgttccgctgatcaccactgttcagggtgtcaccgcagctgtccagggcatagaggccctgcgtgagggcgttgtcagcgtccgcgcgctgcaggaactcgaccacgcagtcaaggcttaagccctatgacattcggcgag

SEQ ID NO: 368 - protein, 1113 aa, Corynebacterium glutamicum
MPKRSDINHVLVIGSGPIVIGQACEFDYSGTQACRVLKEEGLRVTLINSNPATIMTDPEMADHTYVEPIEPEYIDKIFAKEIEQGHPIDAVLATLGGQTALNAAIQLDRLGILEKYGVELIGADIDAIERGEDRQKFKDIVTTIGGESARSRVCHNMEEVHETVAELGLPVVVRPSFTMGGLGSGLAYNTEDLERIAGGGLAASPEANVLIEESILGWKEFELELMRDTADNVVVICSIENVDALGVHTGDSVTVAPALTLTDREFQKMRDQGIAIIREVGVDTGGCNIQFAINPVDGRIITIEMNPRVSRSSALASKATGFPIAKMAAKLAIGYTLDEITNDITGETPAAFEPTIDYVVVKAPRFAFEKFVGADDTLTTTMKSVGEVMSLGRNYIAALNKALRSLETKQQGFWTKPDEFFAGERATDKAAVLEDLKRPTEGRLYDVELAMRLGASVEELYEASSIDPWFLAELEALVQFRQKLVDAPFLNEDLLREAKFMGLSDLQIAALRPEFAGEDGVRTLRLSLGIRPVFKTVDTCAAEFEAKTPYHYSAYELDPAAESEVAPQTEREKVLILGSGPNRIGQGIEFDYSCVHAALELSRVGYETVMVNCNPETVSTDYDTADRLYFEPLTFEDVMEVYHAEAQSGTVAGVIVQLGGQTPLGLADRLKKAGVPVIGTSPEAIDMAEDRGEFGALLNREQLPAPAFGTATSFEEARTVADEISYPVLVRPSYVLGGRGMEIVYDEASLEDYINRATELSSDHPVLVDRFLDNAIEIDVDALCDGDEVYLAGVMEHIEEAGIHSGDSACALPPMTLGAQDIEKVREATKKLALGIGVQGLMNVQYALKDDILYVIEANPRASRTVPFVSKATGVNLAKAASRIAVGATIKDLQDEGMIPTEYDGGSLPLDAPIAVKEAVLPFNRFRRPDGKTLDTLLSPEMKSTGEVMGLANNFGAAYAKAEAGAFGALPTEGTVFVTVANRDKRTLILPIQRLALMGYKILATEGTAGMLRRNGIECEVVLKASDIREGVEGKSIVDRIREGEVDLILNTPAGSAGARHDGYDIRAAAVTVGVPLITTVQGVTAAVQGIEALREGVVSVRALQELDHAVKA

SEQ ID NO: 369 - DNA, 3221 bp, Corynebacterium glutamicum
  CDS (1)..(3198): FRXA02234
ggctccaacccagcaacgatcatgaccgacccagaaatggctgaccacacctacgtggagccaatcgagccggaatacatcgacaagattttcgctaaggaaatcgagcagggccacccaatcgacgccgtcctggcaacccttggtggccagactgcacttaacgcagctatccagctggatcgcctcggcatcctggaaaagtacggcgttgaactcatcggtgcagacatcgatgccattgagcgcggcgaagatcgccagaagttcaaggatattgtcaccaccatcggtggcgaatccgcgcgttcccgcgtctgccacaacatggaagaagtccacgagactgtcgcagaactcggccttccagtagtcgtgcgtccatccttcactatgggtggcctgggctccggtcttgcatacaacaccgaagaccttgagcgcatcgctggtggcggacttgctgcatctcctgaagcaaacgtcttgatcgaagaatccatccttggttggaaggaattcgagctcgagctcatgcgcgataccgcagacaacgttgtggttatctgctccattgaaaacgtcgacgcactgggcgtgcacaccggcgactctgtcaccgtggcacctgccctgaccctgactgaccgtgaattccagaagatgcgcgatcagggtatcgccatcatccgcgaggtcggcgtggacaccggtggatgtaacatccagttcgccatcaacccagttgatggccgcatcatcaccattgagatgaacccacgtgtgtctcgttcctccgctctggcatccaaggcaacgggcttcccaattgccaagatggctgccaagctggctatcggatacaccctggatgagatcaccaacgacatcactggtgaaaccccagctgcgtttgagcccaccatcgactacgtcgtggtcaaggccccacgctttgctttcgagaagtttgtcggcgctgatgacactttgaccaccaccatgaagtccgtcggtgaggtcatgtccctgggccgcaactacattgcagcactgaacaaggcactgcgttccctggaaaccaagcagcagggtttctggaccaagcctgatgagttcttcgcaggggagcgcgctaccgataaggcagctgttctggaagatctcaagcgcccaaccgaaggccgcctctacgacgttgagctggcaatgcgccttggcgcaagcgtggaagaactctacgaagcatcttctattgatccttggttcctcgccgagcttgaagctctcgtgcagttccgccagaagctcgttgacgcaccattcctaaacgaagatctcctgcgcgaagcaaagttcatgggtctgtccgacctgcagatcgcagcccttcgcccagagttcgctggcgaagacggcgtacgcaccttgcgtctgtccctaggcatccgcccagtattcaagactgtggatacctgtgcagcagagtttgaagctaagactccgtaccactactccgcatacgagctggatccagcagctgagtctgaggtcgcaccacagactgagcgtgaaaaggtcctgatcttgggctccggtccaaaccgcatcggccagggcatcgagttcgactactcctgtgttcacgcagctcttgagctctcccgcgtcggctacgaaactgtcatggtcaactgcaacccagagaccgtgtccaccgactacgacaccgctgaccgcctgtacttcgagccactgaccttcgaagacgtcatggaggtctaccacgctgaggcgcagtccggcaccgtcgcaggtgttatcgtccagcttggtggccagactcctctgggcttggcagatcgtttgaagaaggctggcgtccctgtcattggtacctccccagaggcaatcgacatggctgaggaccgtggcgagttcggtgcactgctgaaccgcgagcagcttcctgctccagcattcggcaccgcaacctctttcgaagaggctcgcacagtagccgatgagatcagctacccagtgctggttcgcccttcctacgtcttgggtggccgtggcatggagattgtctacgatgaggcttccctcgaggattacatcaaccgcgcaactgagttgtcttctgaccacccagtgctggttgaccgcttcctagacaacgctattgagatcgacgtcgacgcactgtgcgacggcgacgaggtctacctggcaggcgtcatggagcacatcgaggaagccggcattcactccggtgactccgcatgtgcacttcctccaatgactttgggcgcacaggacatcgagaaggtccgcgaagcaaccaagaagctggctctgggcatcggtgtacagggcctgatgaacgtccagtacgcactcaaggacgacatcctctacgtcatcgaggcaaacccacgtgcatcccgcaccgtgccgttcgtctccaaggcaacgggcgtcaacctggccaaggcagcatcccgtatcgcagtgggcgccaccatcaaggatctccaagatgagggcatgattcctaccgagtacgacggcggctccttgccactggacgctccaatcgctgtgaaggaagcagtgttgccgttcaaccgcttccgtcgcccagatggaaagaccctggacaccctgctttccccagagatgaagtccactggcgaggtcatgggcttggccaacaacttcggcgctgcatatgcaaaggctgaagctggcgcgtttggtgcattgccaaccgaaggcaccgtcttcgtgaccgtggctaaccgcgacaagcgcaccctgatcctgccaatccagcgcctggcgttgatgggctacaagatcctcgccaccgaaggcaccgcaggcatgctgcgccgcaacggcattgagtgtgaagttgtgctcaaggcttccgacatccgcgaaggtgtagagggcaagtccatcgtggatcgtatccgcgaaggcgaagttgacctcatcctcaacaccccagctggttctgctggcgctcgccacgatggctacgatatccgcgcagcagcagtgaccgtgggtgttccgctgatcaccactgttcagggtgtcaccgcagctgtccagggcatagaggccctgcgtgagggcgttgtcagcgtccgcgcgctgcaggaactcgaccacgcagtcaaggcttaagccctatgacattcggcgag

SEQ ID NO: 370 - protein, 1066 aa, Corynebacterium glutamicum
GSNPATIMTDPEMADHTYVEPIEPEYIDKIFAKEIEQGHPIDAVLATLGGQTALNAAIQLDRLGILEKYGVELIGADIDAIERGEDRQKFKDIVTTIGGESARSRVCHNMEEVHETVAELGLPVVVRPSFTMGGLGSGLAYNTEDLERIAGGGLAASPEANVLIEESILGWKEFELELMRDTADNVVVICSIENVDALGVHTGDSVTVAPALTLTDREFQKMRDQGIAIIREVGVDTGGCNIQFAINPVDGRIITIEMNPRVSRSSALASKATGFPIAKMAAKLAIGYTLDEITNDITGETPAAFEPTIDYVVVKAPRFAFEKFVGADDTLTTTMKSVGEVMSLGRNYIAALNKALRSLETKQQGFWTKPDEFFAGERATDKAAVLEDLKRPTEGRLYDVELAMRLGASVEELYEASSIDPWFLAELEALVQFRQKLVDAPFLNEDLLREAKFMGLSDLQIAALRPEFAGEDGVRTLRLSLGIRPVFKTVDTCAAEFEAKTPYHYSAYELDPAAESEVAPQTEREKVLILGSGPNRIGQGIEFDYSCVHAALELSRVGYETVMVNCNPETVSTDYDTADRLYFEPLTFEDVMEVYHAEAQSGTVAGVIVQLGGQTPLGLADRLKKAGVPVIGTSPEAIDMAEDRGEFGALLNREQLPAPAFGTATSFEEARTVADEISYPVLVRPSYVLGGRGMEIVYDEASLEDYINRATELSSDHPVLVDRFLDNAIEIDVDALCDGDEVYLAGVMEHIEEAGIHSGDSACALPPMTLGAQDIEKVREATKKLALGIGVQGLMNVQYALKDDILYVIEANPRASRTVPFVSKATGVNLAKAASRIAVGATIKDLQDEGMIPTEYDGGSLPLDAPIAVKEAVLPFNRFRRPDGKTLDTLLSPEMKSTGEVMGLANNFGAAYAKAEAGAFGALPTEGTVFVTVANRDKRTLILPIQRLALMGYKILATEGTAGMLRRNGIECEVVLKASDIREGVEGKSIVDRIREGEVDLILNTPAGSAGARHDGYDIRAAAVTVGVPLITTVQGVTAAVQGIEALREGVVSVRALQELDHAVKA

SEQ ID NO: 371 - DNA, 1389 bp, Corynebacterium glutamicum
  CDS (101)..(1366): RXS02565
ggaaattcgatacagtgcgatgacgcgatattagaaagaaaaagatgcgctttacgacgaaaccctcaccctccttcaggaacttatccgcaacgcctgcgtgaatgatctaaccccagattcaggtcaggaaattagaaacgcggaaagcctagaacgtttctttgaaggaacccccaacgttaaaatcaccaagctggaaccgcatccgggccggacctcaattatcgtgactgttccaggcagcgatccagatgctgagcctttaacactgcttggacatactgatgttgtgcctgttgatctgcctaaatggactaaagatccattcggtgcggagatttcggatggacagatttggggtagagggtccgtcgatatgctctttattaccgcaacccaagcggccgtcacccgtcaagtagcccgtgaaggcggcctgcgtggcacgctgacattcgttggcgttgctgatgaggaagcccgcggcggactcggagcgaagtggctttccgaagaacaccaaaacctcttcagctggaaaaactgcctctccgaatccggtggatcgcaccttccagtccacgacggcagcgacgcagtagtaattaacgttggagaaaaaggtgcagctcaacgtcgtattcacgtcaatggcgatgctggtcatggttccattcctttcgaccgtgacagcgctattgtcaagatcggtgaagtcgcccgccgaatcgctgccgccgatctgaaggtagccaaggacgatatctggcaaggcttcgtccaagcgcaccgtttcgacccagaaacggagcaggcgcttcttagcgggacctcccctgaggcctacgcagagttcggcggactctcccgcttcgcccacgcggtgtctcatctcacgatcgcccaaactgtggttcgtgcaggtcaagccatcaatgtattgccatcgcatgcgtacttggaactggatatccgtacccttccaggccaaaccaatgactatgttgatgacaccctgcgtgctgctctgggcgatcttgccgatgaagtagaaatcgaacacctcatctctgaagaagcaacggtgagcccaactgattccaggttgtataacaccttggaaaaagttcttggtgatttcttccccgatgcgcctgtggtcccaattatttcctctggtggctctgacctgcgctttggtcgtcgactaggcggtgttggttatggttttgcagttcatgcacgtgaacgaactttggcggaagcaatggggcaacttcactcccatgacgaggcgctgtacctggaagatcttgaactgactgttcggggttatgactccgtcgtgcgtgaattcctaggctaaaaacatgaagcaggagtctt

SEQ ID NO: 372 - protein, 422 aa, Corynebacterium glutamicum
VNDLTPDSGQEIRNAESLERFFEGTPNVKITKLEPHPGRTSIIVTVPGSDPDAEPLTLLGHTDVVPVDLPKWTKDPFGAEISDGQIWGRGSVDMLFITATQAAVTRQVAREGGLRGTLTFVGVADEEARGGLGAKWLSEEHQNLFSWKNCLSESGGSHLPVHDGSDAVVINVGEKGAAQRRIHVNGDAGHGSIPFDRDSAIVKIGEVARRIAAADLKVAKDDIWQGFVQAHRFDPETEQALLSGTSPEAYAEFGGLSRFAHAVSHLTIAQTVVRAGQAINVLPSHAYLELDIRTLPGQTNDYVDDTLRAALGDLADEVEIEHLISEEATVSPTDSRLYNTLEKVLGDFFPDAPVVPIISSGGSDLRFGRRLGGVGYGFAVHARERTLAEAMGQLHSHDEALYLEDLELTVRGYDSVVREFLG

SEQ ID NO: 373 - DNA, 525 bp, Corynebacterium glutamicum
  CDS (101)..(502): RXS02937
gctaccgcgaagaactgtactagttcttccatcagcacccgcagttgtctttgcaagagttcgaaacatccaacgcattggtgacaccggtgttgtcgcggtgatcagcaatggggaaggtccggttgttgcgcttcgtggcgacattgatgcgttgcccatggcggagcgatccggcaaagaatacgcagcaaccggagtgacacaggtggataacaccaccggtcaagaaactccggtggcgcatacctgtggccacgatgtgcatatttcatcactgttgggtgcggtgcaggcgttcaattctcatcgggaattgtggaacggaacgttgatggccgttttccagccagcggaagagacggcagctggtgcgaggatgatggcggatcaggacaacgcgccgggaaatcactctccagcgttcgcgccagatatgcagccaactcttgatcgtggtgtggaagcgctggttgtagctgcttctgcgtggctagtaaaataattggctaatgaatccttttc

SEQ ID NO: 374 - protein, 134 aa, Corynebacterium glutamicum
VISNGEGPVVALRGDIDALPMAERSGKEYAATGVTQVDNTTGQETPVAHTCGHDVHISSLLGAVQAFNSHRELWNGTLMAVFQPAEETAAGARMMADQDNAPGNHSPAFAPDMQPTLDRGVEALVVAASAWLVK

SEQ ID NO: 375 - DNA, 966 bp, Corynebacterium glutamicum
  CDS (101)..(943): RXA02194
gaaatctcccagctcatttattggacccaggtcatcatggttgctcgcggcctgaagccagaagatatctacaagaacctgtaggagttttaaagcaatcatgttgaaaatcgctgtcccaaacaaaggctcgctgtccgagcgcgccatggaaatcctcgccgaagcaggctacgcaggccgtggagattccaaatccctcaacgtttttgatgaagcaaacaacgttgaattcttcttccttcgccctaaagatatcgccatctacgttgctggtggccagctcgatttgggtatcaccggccgcgaccttgctcgcgattcccaggctgatgtccacgaagttctttccctcggcttcggttcctccactttccgttacgcagcaccagctgatgaagagtggagcatcgaaaagctcgacggcaagcgcatcgctacctcttaccccaaccttgttcgcgatgacctcgcagcacgtgggctttccgctgaggtgctccgcctcgacggtgcagtagaggtatccatcaagcttggtgtcgcagatgccatcgccgatgttgtatccaccggccgcacgctgcgtcagcaaggtcttgcacctttcggcgaggttctgtgcacctctgaggctgtcattgttggccgcaaggatgaaaaggtcaccccagagcagcagatcctgcttcgccgcatccagggaattttgcacgcgcagaacttcctcatgctggattacaacgtcgaccgcgacaacctggacgctgccactgcagtaaccccaggcttatccggcccaacggtatccccactggcacgcgacaactgggttgctgtacgcgccatggtgccacgcaggtcagctaacgccatcatggataagcttgctggactcggcgctgaagccatcctggcttctgaaatccgcatcgcccgcatctagttttaactacccccgaaaat

SEQ ID NO: 376 - protein, 281 aa, Corynebacterium glutamicum [sequence omitted]

SEQ ID NO: 377 - DNA, 393 bp, Corynebacterium glutamicum
  CDS (101)..(370): RXA02195
tcgagccggcaggtgtcgcaaaataaaaccaggtgggggagtgaaattattcgactaatatcctcccccaaacacacattgataactgttgtgtggaagaatgtaccgagtgaagacatttgactcgctgtacgaagaacttcttaaccgtgctcagacccgccctgaagggtctggaaccgtggccgccttggataaaggcatccatcatctaggtaagaaggtcatcgaagaagccggagaggtctggattgcagccgagtatgagaccgatgaagagctagccggagaaatctcccagctcatttattggacccaggtcatcatggttgctcgcggcctgaagccagaagatatctacaagaacctgtaggagttttaaagcaatcatgt

SEQ ID NO: 378 - protein, 90 aa, Corynebacterium glutamicum
MYRVKTFDSLYEELLNRAQTRPEGSGTVAALDKGIHHLGKKVIEEAGEVWIAAEYETDEELAGEISQLIYWTQVIMVARGLKPEDIYKNL

SEQ ID NO: 379 - DNA, 477 bp, Corynebacterium glutamicum
  CDS (101)..(454): RXA01097
gcgccaacgcagtgcttgccgcgaccattttccacttccgcgaagtaaccatcgccgaagtaaagggagccattaaagatgcaggatttgaggtgcggaaatgagtgacaatccacaagagtatgagctggattgggacgtcgaaaagcgattaaagcttaacgacgccggcctggtgccggcaatcgtccaggccgacgggaccaacgaggtcctcatgatggcctggatggatacccacgcgctagcctatactttggcgacccgccgtggaacctatttttctaggtcccgcaacgagtactggatcaagggcctgacctctggaaacgtccaagaagtcaccggacttgccctcgactgcgacggcgacaccgtccttctgaccgtgaaacaaaccggcggtgcgtgccacactggtgcccacacatgtttcgacaatgacgttttgctgtaaaagcaacaacgattaaggaa

SEQ ID NO: 380 - protein, 118 aa, Corynebacterium glutamicum
MSDNPQEYELDWDVEKRLKLNDAGLVPAIVQADGTNEVLMMAWMDTHALAYTLATRRGTYFSRSRNEYWIKGLTSGNVQEVTGLALDCDGDTVLLTVKQTGGACHTGAHTCFDNDVLL

SEQ ID NO: 381 - DNA, 861 bp, Corynebacterium glutamicum
  CDS (101)..(838): RXA01100
gctgtgggctactcaattccacccagaaaaatcaggtgacgcaggcgcacagctactgcgaaactggatcaactacatctaacagataggatcaatattcatgaccttcactattcttcctgcagtcgatgtagttaacggacaagcagttcgcctagatcagggcgaggccggcactgaaaagtcttatggcacccctttggaatccgcactgaagtggcaggagcagggtgcaaagtggttgcactttgtggacctggacgcagcgttcaaccgtggttccaaccatgagatgatggcggaaattgtcggcaagctcgatgttgatgtggagctcactggcggtatccgtgatgatgagtctctggagcgcgcgctggcaaccggtgcacgtcgtgtaaacattggtaccgctgctctggagaagccagagtggattgcttctgcgattcaacgctatggcgagaagattgctgtcgatatcgctgtgcgtttggaagatggtgaatggcgcacccgtggaaacggttgggtctccgatggtggcgatctgtgggaagttctcgagcgtttggattcccaaggttgtgcacgtttcgtggttaccgatgtgtccaaggacggcaccttgagtggtccaaatgttgagctgctgcgtgaggttgctgcagctacagacgcacctatcgtggcatctggtggaatttctgttttggaagatgttttggaactagccaagtaccaggatgagggcattgattccgtcatcattggcaaggcactttatgagcacaagttcaccctcgaagaggctttggctgcagtagaaaagctcggttaatacatggatgctcgtgggat

SEQ ID NO: 382 - protein, 246 aa, Corynebacterium glutamicum
MTFTILPAVDVVNGQAVRLDQGEAGTEKSYGTPLESALKWQEQGAKWLHFVDLDAAFNRGSNHEMMAEIVGKLDVDVELTGGIRDDESLERALATGARRVNIGTAALEKPEWIASAIQRYGEKIAVDIAVRLEDGEWRTRGNGWVSDGGDLWEVLERLDSQGCARFVVTDVSKDGTLSGPNVELLREVAAATDAPIVASGGISVLEDVLELAKYQDEGIDSVIIGKALYEHKFTLEEALAAVEKLG

SEQ ID NO: 383 - DNA, 756 bp, Corynebacterium glutamicum
  CDS (101)..(733): RXA01101
atcgcagctaggccagtgtggtggatataaaacccttttggggagaaagaaactcgactgcggttcttgatcctgaaagcacgtgacataaactatcggcatgaccaaaactgtcgcccttctcgactacggatctggaaaccttcgttctgctcaacgcgcactagagcgtgccggtgcagaagttatcgtgagctccgatccagaagtttgcaccaacgctgatggcctcctagttcctggagtgggcgcatttgatgcctgcatgaagggtttgaaaaacgtcttcggacatcgcattatcggacagcgtcttgctggtggacgtccagtgatgggtatttgtgtgggcatgcagatcctgttcgatgaaggcgatgagcacggcattaagtcagctggttgcggcgagtggcctggcaaagtggaacgcctccaagcggagatcctgcctcacatggggtggaacacacttgaaatgcctaccaactcaccaatgtttgagggaatttcacctgatgagcgtttctacttcgtgcactcctatggtgtgcgcaagtggacgttggaaaccgacgatctgaccacgcctccagaggttgtgtgggcgaagcacgaaaatgatcgttttgtggcagctgtggaaaacggcacgctgtgggctactcaattccacccagaaaaatcaggtgacgcaggcgcacagctactgcgaaactggatcaactacatctaacagataggatcaatattcat

SEQ ID NO: 384 - protein, 211 aa, Corynebacterium glutamicum
MTKTVALLDYGSGNLRSAQRALERAGAEVIVSSDPEVCTNADGLLVPGVGAFDACMKGLKNVFGHRIIGQRLAGGRPVMGICVGMQILFDEGDEHGIKSAGCGEWPGKVERLQAEILPHMGWNTLEMPTNSPMFEGISPDERFYFVHSYGVRKWTLETDDLTTPPEVVWAKHENDRFVAAVENGTLWATQFHPEKSGDAGAQLLRNWINYI

SEQ ID NO: 385 - DNA, 723 bp, Corynebacterium glutamicum
  CDS (101)..(700): RXN01657
cctccgtcattgccgacgtatcccgcggcctgggtgaagccatggtgggcatcaacgtatccgacgttccagcaccacaccgactcgccgagcgcggctggtgatcgttggagttttagctctccagggcggggtggaagaacacctcaccgccttggaagctctcggagcgacgacccgaaaagtacgtgtgccaaaggaccttgatggtctcgaaggcatcgtcatccccggcggggaatccaccgtgttggacaaactggctcggacattcgacgtggtagaacctctagcgaatctcattcgcgacggcctacccgttttcgctacctgcgctggcctgatctatctggcgaaacacctcgacaacccagcaaggggacaacaaaccttggcggtagtggacgtggtggtgcgtcgaaacgcatttggcgcccaacgcgaatccttcgacaccaccgtggatgtttccttcgacggtgcaacattccccggagtgcaggcctcgtttatccgagctcccatcgtcactgcttttggtcctacggtagaagcgatcgctgctctcaacggtggggaggtggttggtgtacgccaaggcaacatcatcgcgctgtctttccatcccgaagaaaccggcgattaccgcatccaccaagcctggctggacctggtgagaaaacacgctgaactggcgatttgatgttttcggtagcgctctgt

SEQ ID NO: 386 - protein, 200 aa, Corynebacterium glutamicum
VIVGVLALQGGVEEHLTALEALGATTRKVRVPKDLDGLEGIVIPGGESTVLDKLARTFDVVEPLANLIRDGLPVFATCAGLIYLAKHLDNPARGQQTLAVVDVVVRRNAFGAQRESFDTTVDVSFDGATFPGVQASFIRAPIVTAFGPTVEAIAALNGGEVVGVRQGNIIALSFHPEETGDYRIHQAWLDLVRKHAELAI

SEQ ID NO: 387 - DNA, 601 bp, Corynebacterium glutamicum
  CDS (101)..(601): FRXA01657
cctccgtcattgccgacgtatcccgcggcctgggtgaagccatggtgggcatcaacgtatccgacgttccagcaccacaccgactcgccgagcgcggctggtgatcgttggagttttagctctccagggcggggtggaagaacacctcaccgccttggaagctctcggagcgacgacccgaaaagtacgtgtgccaaaggaccttgatggtctcgaaggcatcgtcatccccggcggggaatccaccgtgttggacaaactggctcggacattcgacgtggtagaacctctagcgaatctcattcgcgacggcctacccgttttcgctacctgcgctggcctgatctatctggcgaaacacctcgacaacccagcaaggggacaacaaaccttggcggtagtggacgtggtggtgcgtcgaaacgcatttggcgcccaacgcgaatccttcgacaccaccgtggatgtttccttcgacggtgcaacattccccggagtgcaggcctcgtttatccgagctcccatcgtcactgcttttggtcctacggtagaagcgatcgctgctctcaacggtggggaggtggttggtgtacgccaaggc

SEQ ID NO: 388 - protein, 167 aa, Corynebacterium glutamicum
VIVGVLALQGGVEEHLTALEALGATTRKVRVPKDLDGLEGIVIPGGESTVLDKLARTFDVVEPLANLIRDGLPVFATCAGLIYLAKHLDNPARGQQTLAVVDVVVRRNAFGAQRESFDTTVDVSFDGATFPGVQASFIRAPIVTAFGPTVEAIAALNGGEVVGVRQG

SEQ ID NO: 389 - DNA, 897 bp, Corynebacterium glutamicum
  CDS (101)..(874): RXA01098
aaaagggctcacgatgtgctgttaagtaagattgaaaaagttcggttgatgcatgcagatgcaggtaatgaccagtcgttaaatgaggagtacaagtaaaatgggcgtggcaattcgagttattccttgcctggacgtggacaacggccgggttgttaaaggcgtgaactttgaaaacctccgcgatgctggcgatcctgtggagttggcaaagcgctatgacgaggaaggggcagatgagctgaccttcctggatgtcaccgcctcgaagcatggtcgcggcaccatgctggatgttgttcgacgcaccgctgatcaggtgttcatccctctgactgtcggtggcggcgtgcgcagcgaagaagatgttgatcaattgctgcgcgctggcgccgacaaggtttcggtgaacacgtctgcgattgcccgtccagaactgctgtcagagctgtccaagcgttttggtgctcagtgcatcgtgttgtctgtggatgccaggcgcgttcctgaaggtggaactcctcagccatctggttttgaagtcaccacccacggcggttccaagtccgcagaacttgatgcaatcgagtgggcaaagcgcggcgaagagctgggcgttggcgaaattctgctcaactccatggacggcgacggcaccaaaaacggctttgacctagagctgctggaaaaagttcgcgcagccgtatccattcctgtaatcgcctccggcggcgctggcaaggcggagcatttcccaccagctgttgcagctggcgccaacgcagtgcttgccgcgaccattttccacttccgcgaagtaaccatcgccgaagtaaagggagccattaaagatgcaggatttgaggtgcggaaatgagtgacaatccacaagagtat

SEQ ID NO: 390 - protein, 258 aa, Corynebacterium glutamicum
MGVAIRVIPCLDVDNGRVVKGVNFENLRDAGDPVELAKRYDEEGADELTFLDVTASKHGRGTMLDVVRRTADQVFIPLTVGGGVRSEEDVDQLLRAGADKVSVNTSAIARPELLSELSKRFGAQCIVLSVDARRVPEGGTPQPSGFEVTTHGGSKSAELDAIEWAKRGEELGVGEILLNSMDGDGTKNGFDLELLEKVRAAVSIPVIASGGAGKAEHFPPAVAAGANAVLAATIFHFREVTIAEVKGAIKDAGFEVRK

SEQ ID NO: 391 - DNA, 729 bp, Corynebacterium glutamicum
  CDS (101)..(706): RXN01104
cacttgcgcactaccattggtgtgcctgaggaaaatgatgcgtttttggacgcagctgcagagatcatcaagctgaacctgtaagagagaagaatttttcatgactgtcgcaccaagaattggtaccgcaacccgcaccaccagcgaatccgacatcaccgtcgagatcaacctggacggcaccggcaaagtagatatcgataccggcctgccatttttcgaccacatgctcactgcattcggcgtgcacggcagttttgatctgaaagtccatgccaagggcgacatcgagatcgacgcacaccacaccgtggaagataccgccatcgtgctcggccaagcactccttgacgctattggcgacaagaaaggcatccgccgtttcgcatcctgccagctgcccatggatgaggcattagtggagtccgtggtggatatctccggtcgcccatacttcgtgatctccggcgaaccagaccacatgatcacctccgtgatcggtggacactacgcaaccgtgatcaacgagcacttctttgaaaccctcgcgctcaactcccgaatcaccctccacgtgatctgccactacggccgcgaccctcaccacatcaccgaagcagagtacaaggctgttgcccgtgcgctgcgcggtgccgtagagatggatcctcgtcaaacaggaatcccatccactaagggagcgctctagacatgaactcttctcccatc

SEQ ID NO: 392 - protein, 202 aa, Corynebacterium glutamicum
MTVAPRIGTATRTTSESDITVEINLDGTGKVDIDTGLPFFDHMLTAFGVHGSFDLKVHAKGDIEIDAHHTVEDTAIVLGQALLDAIGDKKGIRRFASCQLPMDEALVESVVDISGRPYFVISGEPDHMITSVIGGHYATVINEHFFETLALNSRITLHVICHYGRDPHHITEAEYKAVARALRGAVEMDPRQTGIPSTKGAL

SEQ ID NO: 393 - DNA, 729 bp, Corynebacterium glutamicum; identical to SEQ ID NO: 391
  CDS (101)..(706): FRXA01104

SEQ ID NO: 394 - protein, 202 aa, Corynebacterium glutamicum; identical to SEQ ID NO: 392

SEQ ID NO: 395 - DNA, 987 bp, Corynebacterium glutamicum
  CDS (101)..(964): RXN00446
tgctacgaagttatctagtaatgaagttagtttttcccctctcccggcagcagttgatgcggtgacggaggctacttggggggctaatcggtacccggatatgggtgcggttgagctccgtgaggctcttgcagagcatttagaggttgagtttgaccaggtcacggtaggttgcggctcgtctgcgctgtgtcaacagctggttcaggcaacgtgcgctcagggcgatgaggtcatttttccatggcgcagctttgaggcttatccaattttcgcgcaggtcgcgggcgccactcctgttgccattccgctgactgctgatcagaatcatgatcttgatgcgatggcagccgcgatcactgataagacccgcctcattttcatctgcaaccccaacaatccttcgggcaccaccatcacccaggcgcagtttgataatttcatggaaaaggttccaaacgatgtcgttgttgggctggatgaggcttattttgagttcaaccgcgcggacgacaccccagttgccactgaggaaatccaccgccacgacaacgtgattggtttgcgcacgttctccaaggcgtatggcctggcgggcttgcgtgttggttacgccttcggaaacgcagagatcatcgcagcgatgaataaggtggctattcctttcgcggtgaattcagcagctcaggcggcagcgcttgcgagtttgaattctgccgatgagttgatggaacgggtggaggaaaccgtcgaaaagcgtgatgctgtggtgtcagcgcttggtgctgcgccgacgcaggccaatttcgtctggctgccgggcgagggcgccgctgagttggcggctaaattggccgagcacggcatcgtgattcgcgcgttccccgagggtgcgcgcatttcggtgaccaacgccgaggaaactgacaagctgctgcgcgcgtgggaggccatcaatgctgggtagtctttggcgttttgcggtgc

SEQ ID NO: 396 - protein, 288 aa, Corynebacterium glutamicum
MGAVELREALAEHLEVEFDQVTVGCGSSALCQQLVQATCAQGDEVIFPWRSFEAYPIFAQVAGATPVAIPLTADQNHDLDAMAAAITDKTRLIFICNPNNPSGTTITQAQFDNFMEKVPNDVVVGLDEAYFEFNRADDTPVATEEIHRHDNVIGLRTFSKAYGLAGLRVGYAFGNAEIIAAMNKVAIPFAVNSAAQAAALASLNSADELMERVEETVEKRDAVVSALGAAPTQANFVWLPGEGAAELAAKLAEHGIVIRAFPEGARISVTNAEETDKLLRAWEAINAG

SEQ ID NO: 397 - DNA, 545 bp, Corynebacterium glutamicum
  CDS (1)..(522): FRXA00446
atggaaaaggttccaaacgatgtcgttgttgggctggatgaggcttattttgagttcaaccgcgcggacgacaccccagttgccactgaggaaatccaccgccacgacaacgtgattggtttgcgcacgttctccaaggcgtatggcctggcgggcttgcgtgttggttacgccttcggaaacgcagagatcatcgcagcgatgaataaggtggctattcctttcgcggtgaattcagcagctcaggcggcagcgcttgcgagtttgaattctgccgatgagttgatggaacgggtggaggaaaccgtcgaaaagcgtgatgctgtggtgtcagcgcttggtgctgcgccgacgcaggccaatttcgtctggctgccgggcgagggcgccgctgagttggcggctaaattggccgagcacggcatcgtgattcgcgcgttccccgagggtgcgcgcatttcggtgaccaacgccgaggaaactgacaagctgctgcgcgcgtgggaggccatcaatgctgggtagtctttggcgttttgcggtgc

SEQ ID NO: 398 - protein, 174 aa, Corynebacterium glutamicum
MEKVPNDVVVGLDEAYFEFNRADDTPVATEEIHRHDNVIGLRTFSKAYGLAGLRVGYAFGNAEIIAAMNKVAIPFAVNSAAQAAALASLNSADELMERVEETVEKRDAVVSALGAAPTQANFVWLPGEGAAELAAKLAEHGIVIRAFPEGARISVTNAEETDKLLRAWEAINAG

SEQ ID NO: 399 - DNA, 1221 bp, Corynebacterium glutamicum
  CDS (101)..(1198): RXA01105
ttgtcatcaactttgccaacgccgaagatcttccagcgcacggcgaagcaatccgtgcacgctttgaaaacctccccaccaccgacgaggcctaagaaaaatgaccaaaattactttgagcgatttgccattgcgtgaagaactgcgcggtgagcacgcttacggcgcaccccagctcaacgttgatattcgcctcaacaccaacgaaaacccttacccaccgtcagaggcattggtcgctgacttggttgccaccgtggataagatcgccaccgagctgaaccgctacccagagcgcgatgctgtggaactgcgtgatgagttggctgcgtacatcaccaagcaaaccggcgtggctgtcaccagggataacctgtgggctgccaatggttccaatgaaattctgcagcagctgctgcaggcttttggtggacctggacgcaccgcgttgggattccaacccagctattccatgcacccaattttggctaaaggcacccacactgaattcattgcggtgtcccgaggtgctgatttccgcatcgatatggatgtggcgctggaagaaattcgtgcaaagcagcctgacattgtttttgtcaccaccccgaacaacccgaccggtgatgtgacctcgctggacgatgttgagcgcatcatcaacgttgccccaggcatcgtgatcgtggatgaagcttatgcggaattctccccatcaccttcagcaaccactcttctggagaagtacccaaccaagctggtggtgtcccgcaccatgagtaaggcttttgatttcgcaggtggacgcctcggctacttcgtggccaacccagcgtttatcgacgccgtgatgctagtccgccttccgtatcatctttcagcgctgagccaagcagccgcaatcgtagcgctgcgtcactccgctgacacgctgggaaccgtcgaaaagctctctgtagagcgtgttcgcgtggcagcacgcttggaggaactgggctacgctgtggttccaagtgagtccaactttgtgttctttggagatttctccgatcagcacgcggcatggcaggcatttttggataggggagtgctcatccgcgatgtgggaatcgctgggcacttgcgcactaccattggtgtgcctgaggaaaatgatgcgtttttggacgcagctgcagagatcatcaagctgaacctgtaagagagaagaatttttcatga

SEQ ID NO: 400 - protein, 366 aa, Corynebacterium glutamicum
MTKITLSDLPLREELRGEHAYGAPQLNVDIRLNTNENPYPPSEALVADLVATVDKIATELNRYPERDAVELRDELAAYITKQTGVAVTRDNLWAANGSNEILQQLLQAFGGPGRTALGFQPSYSMHPILAKGTHTEFIAVSRGADFRIDMDVALEEIRAKQPDIVFVTTPNNPTGDVTSLDDVERIINVAPGIVIVDEAYAEFSPSPSATTLLEKYPTKLVVSRTMSKAFDFAGGRLGYFVANPAFIDAVMLVRLPYHLSALSQAAAIVALRHSADTLGTVEKLSVERVRVAARLEELGYAVVPSESNFVFFGDFSDQHAAWQAFLDRGVLIRDVGIAGHLRTTIGVPEENDAFLDAAAEIIKLNL

SEQ ID NO: 401 - DNA, 1449 bp, Corynebacterium glutamicum
  CDS (101)..(1426): RXA01106
ggtaaacatgcgggcttaagaacttgtgttgaggccgcttggattcgggcaccgagctcgaagaatttcgattcaaccttttaagggagaacttttcgccatgttgaatgtcactgacctgcgaggtcaaacaccatccaagagcgacatccgacgtgctttgccacgtggtggcactgacgtgtggtctgtgcttcccatagtgcagcctgttgtagaagatgtccaaaaccgcggcgctgaagctgctttggattacggcgagaagttcgaccatattcgccccgcctcggtgcgggtgccagctgaggttattgctgcagcagaaaacaccttagatccgttggtgcgtgaatcgattgaagagtcgattcgtcgcgtccgcaaggttcacgctgagcaaaagccatccgagcacaccactgaactttcaccaggtggcaccgtcactgagcgtttcatgccgattgatcgcgtgggactgtacgttccaggcggcaatgcggtgtacccatcaagcgtgattatgaatactgtcccagctcaagaggctggtgtgaactcccttgtggttgcgtcgcctcctcaggctgagcacggtggctggcctcaccccaccattttggcggcgtgttccatcttgggtgttgatgaggtgtgggctgtcggcggcggtcaggccgtggcgttgctggcttatggtgatgacgctgcaggtctcgagcctgtggatatgatcactggacctggcaatatctttgtcaccgctgcgaagcgcctggtcaggggagtggtaggtactgattctgaggctggccctacagaaatcgctgtgcttgctgatgcctctgccaacgccgtcaacgttgcctacgatctgatcagccaagcagaacacgatgtcatggctgcgtccgtgctcatcactgactccgagcagcttgccaaggacgtaaacagggaaatcgaggcgcgttactcaatcacgcgcaacgccgagcgcgtcgcagaagctttgcgcggggcccagagtggcatcgtgcttgtcgacgacatttccgtgggtatccaagtagccgatcaatacgcagcggaacacctggaaatccacactgagaacgcgcgcgccgtagcagagcagatcaccaacgcgggtgcgatcttcgtgggcgatttctcaccagtaccactgggtgattactccgcaggatccaaccacgtgctgccaacctctggatccgctcgtttctccgcaggtctatccacgcacacgttccttcgcccagtcaacctcattgaatacgatgaggctgctctgaaggacgtctcgcaggttgtcatcaactttgccaacgccgaagatcttccagcgcacggcgaagcaatccgtgcacgctttgaaaacctccccaccaccgacgaggcctaagaaaaatgaccaaaattact

SEQ ID NO: 402 - protein, 442 aa, Corynebacterium glutamicum
MLNVTDLRGQTPSKSDIRRALPRGGTDVWSVLPIVQPVVEDVQNRGAEAALDYGEKFDHIRPASVRVPAEVIAAAENTLDPLVRESIEESIRRVRKVHAEQKPSEHTTELSPGGTVTERFMPIDRVGLYVPGGNAVYPSSVIMNTVPAQEAGVNSLVVASPPQAEHGGWPHPTILAACSILGVDEVWAVGGGQAVALLAYGDDAAGLEPVDMITGPGNIFVTAAKRLVRGVVGTDSEAGPTEIAVLADASANAVNVAYDLISQAEHDVMAASVLITDSEQLAKDVNREIEARYSITRNAERVAEALRGAQSGIVLVDDISVGIQVADQYAAEHLEIHTENARAVAEQITNAGAIFVGDFSPVPLGDYSAGSNHVLPTSGSARFSAGLSTHTFLRPVNLIEYDEAALKDVSQVVINFANAEDLPAHGEAIRARFENLPTTDEA

SEQ ID NO: 403 - DNA, 876 bp, Corynebacterium glutamicum
  CDS (101)..(853): RXC00930
acggcgcaccacacatttggtggtgtattgagctatctctgggctgcgtgagaaaccattttccggtggatgatggaagctagacgacgaaagggagcatatgtctggccactcaaaatgggcgactaccaagcacaagaaggctgctaacgacgccaagcgaggcaaggaatttgccaagctgatcaagaacatcgaagttgcggcacgtacaggcggtggagatccgtctgcgaacccaacgcttgatgacatgatcaagaaagccaagaaggcttctgtgccgaacgataacatcgaacgtgcacgcaagcgtggctccggcgaagaagctggtggcgctgactggatgaacatcatgtacgagggatacggccccaacggcgttgccatgcttatcgagtgtctgaccgacaaccgtaaccgcgcagctaccgaagttcgcaccgcaatgaccaaaaacggtggcaacttgggcgagtccggttccgtgtcctacatgttcacccgcaccggtgtcgtcaccgtacaaaagggcgatcttagtgaagatgacgtgctcatggctgttcttgaagctggtgctgaagaagtcaacgacaacggcgatctgttcgaggttacctgcgcaccaactgacattcaggctgttcgcgacgcactcgtggaagctggcattgaagtagaagattctgaatcagacttccgggcatctgttcaggtccccctggacgctgacggtgcacgcaagatcttcaagcttgtggacgcgttggaagattccgacgatgtgcaaaacgtctacaccaacatcgacttgagcgatgaggttttgacagagctggaaaacgactagttcgtattttccgcactccg

SEQ ID NO: 404 - protein, 251 aa, Corynebacterium glutamicum
MSGHSKWATTKHKKAANDAKRGKEFAKLIKNIEVAARTGGGDPSANPTLDDMIKKAKKASVPNDNIERARKRGSGEEAGGADWMNIMYEGYGPNGVAMLIECLTDNRNRAATEVRTAMTKNGGNLGESGSVSYMFTRTGVVTVQKGDLSEDDVLMAVLEAGAEEVNDNGDLFEVTCAPTDIQAVRDALVEAGIEVEDSESDFRASVQVPLDADGARKIFKLVDALEDSDDVQNVYTNIDLSDEVLTELEND

SEQ ID NO: 405 - DNA, 547 bp, Corynebacterium glutamicum
  CDS (101)..(547): RXC01096
accgtgaaacaaaccggcggtgcgtgccacactggtgcccacacatgtttcgacaatgacgttttgctgtaaaagcaacaacgattaaggaagaaatcttatgaagccacgcgtgctgtcagcattaggcattggagctggcgccctggttgtctggatcagctcacgcatgaactgggtaaccatcgaggctttcgacgataaatcaggtagtgtcacccaatctattgtgggtgcaacctggtctacagaaatcatggcgcttgcacttgctttgctcgctgccttcgccgccgcgttggtgctcaagcgcatgggtcggcgcatcattggtggtatttcggcgctgatcgcggtgggtgccagcctgtctccactcgcgcttctcacccaagacccagacgcagaacgggcccgaaccctgctgacctccggtgtggcctcacagaaggctaattccggaaccctgctgtctgattgggcggagatcatcaataccaccacccatccactggcggcagtggtagccatgattggctgcgcgcta

SEQ ID NO: 406 - protein, 149 aa, Corynebacterium glutamicum
MKPRVLSALGIGAGALVVWISSRMNWVTIEAFDDKSGSVTQSIVGATWSTEIMALALALLAAFAAALVLKRMGRRIIGGISALIAVGASLSPLALLTQDPDAERARTLLTSGVASQKANSGTLLSDWAEIINTTTHPLAAVVAMIGCAL

SEQ ID NO: 407 - DNA, 1020 bp, Corynebacterium glutamicum
  CDS (101)..(997): RXC01656
tcggcaagcatggcttcatcgtcctcaaaaaagtggtctaatgcaagtgactgaaagtggatctaccgctagtccactttgtggcgttggatcatctgtcatgaccgaaactcaagaaacttaccaagcaaccactcgtgtgaagcgcggccttgccgacatgctcaagggtggtgtgatcatggatgtggtcacccctgaacaagcgcgcatcgccgaagatgcaggtgccagcgcagttatggcactcgagcgcgttcccgccgatatccgttctcagggcggcgttgctcgcatgagtgatcctgacctgatcgaaggaatcgtcaatgcggtctccatcccggtcatggcgaaagctcgcatcggtcacttcgtggaagctcaggttctggaagctctcggtgttgatttcatcgacgagtccgaagttctcagccctgccgactacacgcaccacatcaacaagtggaagttcgacgttcctttcgtctgtggcgcgaccaacctcggcgaagctttgcgacgcatcaccgaaggcgctgcaatgatccgttccaagggcgaagccggcaccggcgatgtctctgaagctgtccgtcacctgcgcaccatccgcggcgacatcaatcgcctgcgctccctggatgaggatgaactcttcgtcgccgccaaggaattccaggcaccatacgacctggtccgcgaagtcgcctccaccggcaagctccctgtggtcaccttcgttgcaggtggcgtcgcaaccccagccgacgctgcactcgtgcgccaaatgggcgccgaaggcgtctttgtcggctccggcatcttcaaatccggcaatccagccgcccgcgccgcagcgatcgtcaaggctgcaacgcttttcgacgacccctccgtcattgccgacgtatcccgcggcctgggtgaagccatggtgggcatcaacgtatccgacgttccagcaccacaccgactcgccgagcgcggctggtgatcgttggagttttagctctc

SEQ ID NO: 408 - protein, 299 aa, Corynebacterium glutamicum
MTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 409 - DNA, 1065 bp, Corynebacterium glutamicum
  CDS (101)..(1042): RXC01158
taggacgttcaaggaattggctgaatcaacaagcgccaaggtggttaagcgccctcggcgagttatctcaaaaaagaagaagaagtctcctacgggagagatgtccattgttgagcacatcaaagagtttcgacgccgacttcttatcgctctggcgggcatcctcgtgggcaccattatcggctttatttggtacgatttctcattttggcagatccccactttgggcgagctgctgagggatccgtactgttctctgcctgctgaatcccgctgggccatgagcgactcagaggaatgtcgactgctcgcaaccggcccgtttgatccattcatgcttcgccttaaagtagcggcgttggtgggtatggttcttggctcacccgtgtggctgagccagctgtggggctttatcaccccaggtttgatgaagaatgagcgccgttacaccgcaatcttcgtcacgattgctgttgtgctgtttgtcggcggtgctgttcttgcgtacttcgtcgttgcatatggtttggagttcctccttaccattggtggagacacccaggcagcggccctgactggtgataagtacttcggattcttgctcgcgttgttggcgattttcggcgtgagcttcgaagttccactggtgatcggcatgctcaacattgtgggtatcttgccttacgatgccattaaagataagcgacgcatgatcatcatgattttgttcgtgttcgctgctttcatgacacccggccaggatcctttcaccatgttggtgttggcgctttcactcaccgttctggtagagcttgccctgcagttctgtcgcttcaacgacaaacgccgggacaagaagcgcccagaatggcttgatggcgatgacctctctgcatcaccactggatacttctgctggtggagaagatgctccaagcccagtcgaaaccccagaggcggtggagccttcgcggatgctgaacccaagtggggaggcgtcgataagctataaacccgggcgcgccgacttcggtgacgtgctctagggcctagccaggtaccctta

SEQ ID NO: 410 - protein, 314 aa, Corynebacterium glutamicum
MSIVEHIKEFRRRLLIALAGILVGTIIGFIWYDFSFWQIPTLGELLRDPYCSLPAESRWAMSDSEECRLLATGPFDPFMLRLKVAALVGMVLGSPVWLSQLWGFITPGLMKNERRYTAIFVTIAVVLFVGGAVLAYFVVAYGLEFLLTIGGDTQAAALTGDKYFGFLLALLAIFGVSFEVPLVIGMLNIVGILPYDAIKDKRRMIIMILFVFAAFMTPGQDPFTMLVLALSLTVLVELALQFCRFNDKRRDKKRPEWLDGDDLSASPLDTSAGGEDAPSPVETPEAVEPSRMLNPSGEASISYKPGRADFGDVL

SEQ ID NO: 411 - DNA, 1413 bp, Corynebacterium glutamicum
  CDS (101)..(1390): RXA02458
ttgcggagccacgactgatcggtcaagtgctatctcggttgcatcaataagcgaatcaccggtggtgaacaaaacaaatcttccacacataacatctattatggtctttgtgtctgattcgtctatctctttgcccatttgggatgctccgcgcgctcgcggccccatagtctcggacctggctatccctggttccaagtcgatcaccaaccgcgccctcatcttggctgcgctcgcatcaactccatccaccatcattgatgtccttcgtagtcgtgataccgatctcatgactgatggtctacgcagcctcggaatcaccattactgaagaggcagtcgatcgctaccgcgttgagcccggacagttgtctgctggctccgttgagtgtggtcttgctggtacggtcatgcgctttttgcctcctgttgctgctttcgctgatggtcctgttcattttgatggcgatcctcaagctcgtgttcgtccgatgaccagcattttggatgcgctgcgttcgcttggtgtggaggtagacaacaacaatctgcctttcactgttaatgctggtgaggtccctgagggtggcgtggttgagattgatgcttccggctcatctcagtttgtttctggtcttttgctttcagcgcctcgttttaaaaatggcgtcaccgttaagcacgtcggtggtcgtctgccgagcatgccgcatattgagatgaccgtcgatatgcttcgttccgcaggcattgagatcgaagagtcagaaaatcagtgggttgttcatcctggtgagatcttgggtcggacctggcgcattgagccggatctttctaatgcgactccgttcctagctgccgctgcggtcactggtggaaccatcaagattaaccactggccaatcaaaactactcagcctggcgatgctattcgttcgattcttgagcgcatgggctgcgaagttgagctggttgctcagggtgaaggttacgatctgtcggtgactggtccggttgctctcaagggcattgagatcgatatgtccgatatcggtgagttgacccctaccgtggcggcgttggctgcgttggcgtcgacagagtctcgtttgaccggtattgctcatcttcgtggccatgagacggatcgtttggctgcgttgactgcggagatcaacaaacttggtggaaagtgcactgagcttaaggatggtctgttgattgagcctgcgtcgctgcacggtggtgtgtggcattcatatgctgatcaccgtatggctactgctggtgcgatcattggcctcgcggttgatggcgttcaggttgaagacattaagaccacttccaaaactttccctggttttgaaaatgtttgggaggagatggttggctagacgcagctatgacgaatccg

SEQ ID NO: 412 - protein, 430 aa, Corynebacterium glutamicum
MVFVSDSSISLPIWDAPRARGPIVSDLAIPGSKSITNRALILAALASTPSTIIDVLRSRDTDLMTDGLRSLGITITEEAVDRYRVEPGQLSAGSVECGLAGTVMRFLPPVAAFADGPVHFDGDPQARVRPMTSILDALRSLGVEVDNNNLPFTVNAGEVPEGGVVEIDASGSSQFVSGLLLSAPRFKNGVTVKHVGGRLPSMPHIEMTVDMLRSAGIEIEESENQWVVHPGEILGRTWRIEPDLSNATPFLAAAAVTGGTIKINHWPIKTTQPGDAIRSILERMGCEVELVAQGEGYDLSVTGPVALKGIEIDMSDIGELTPTVAALAALASTESRLTGIAHLRGHETDRLAALTAEINKLGGKCTELKDGLLIEPASLHGGVWHSYADHRMATAGAIIGLAVDGVQVEDIKTTSKTFPGFENVWEEMVG

SEQ ID NO: 413 - DNA, 1266 bp, Corynebacterium glutamicum
  CDS (101)..(1243): RXA02790
tggatgctcgcacccgagcccttgaaccacaatccacagacacccaagatttcgacgagaagggaaatttcccaggatgaaccaaatccgaaaccgccggatggagcccgtctacgtaaagcgccgccaacggtttattgccgtgacgatcgcttcactcatcctcattatcggtgccatcatctatatcggtgtagccacctcaaaccggacgccacatgactatgaaggctccggaaacggtgtggttcagctggtcgaaatccctgaaggttcctccatatcagagctcggcccagagttggaagaacgagatatcgtggccaccaactcagcgttccaaacagcggccagcaacaaccccaacgcgggtagtgtacagccaggtttctaccgtctgcaggaacaaatgaacgcagcagctgcagtgtcggctctgcttgatccagacaaccaggttgatctcctcgacattcacggcggcgccaccttgatggacgtcactgttgtcggcggaaacacccgcgcgggaatctactcccagatcgcagccgtgacctgcaccgaaggctccgccaactgcatcaccgctgaggatttgcagcaggttgcctccaccgtgtcgcctgcagaattgggtgtcccagattgggcaatcgctgctgtggaagctcgcggaactgatccaaagcgcctcgaaggcctgatcatgcctggccaatacgtggtggatccatccaacgacgcccagggaatcctcaccgatctgatcacgcgatcagcaaaccatttccaagaaaccgacatcacgggccgtgcagatgccatcggacttactccatatgagctggtcaccgcagcatctttaatcgagcgcgaagcaccagcaggagattttgataaggtcgcccgcgtcatcttgaaccgtctcgccgagccaatgcagctgcaattcgactccaccgtcaactacggtctgtctgaacaagaagtagcaaccaccgacgaagaccgtcagaccgtcaccccatggaacacttacgccatggacggcctgccacaaacccccatcgccgcagtatccaccgaagcactccaagccatggaaaaccctgcagaaggaaactggctgtactttgtcaccatcgacaccgatggaaccaccgtgttcaacgacaccttcgaagagcacgaagccgacattgagcaagctttgaacagtggcgttctagacagcaaccgataaggatcagcgaataaaattgg

SEQ ID NO: 414 - protein, 381 aa, Corynebacterium glutamicum
MEPVYVKRRQRFIAVTIASLILIIGAIIYIGVATSNRTPHDYEGSGNGVVQLVEIPEGSSISELGPELEERDIVATNSAFQTAASNNPNAGSVQPGFYRLQEQMNAAAAVSALLDPDNQVDLLDIHGGATLMDVTVVGGNTRAGIYSQIAAVTCTEGSANCITAEDLQQVASTVSPAELGVPDWAIAAVEARGTDPKRLEGLIMPGQYVVDPSNDAQGILTDLITRSANHFQETDITGRADAIGLTPYELVTAASLIEREAPAGDFDKVARVILNRLAEPMQLQFDSTVNYGLSEQEVATTDEDRQTVTPWNTYAMDGLPQTPIAAVSTEALQAMENPAEGNWLYFVTIDTDGTTVFNDTFEEHEADIEQALNSGVLDSNR

SEQ ID NO: 415 - DNA, 644 bp, Corynebacterium glutamicum
  CDS (1)..(621): RXN00954
gctgtgaagtggttcgaagcgtccaacttcaccttcctgttcgcacctgcgtacaaccctgcgattgcgcatgtgcagccggttcgccaggcgctgaaattccccaccatcttcaacacgcttggaccattgctgtccccggcgcgcccggagcgtcagatcatgggcgtggccaatgccaatcatggacagctcatcgccgaggtcttccgcgagttgggccgtacacgcgcgcttgttgtgcatggcgcaggcaccgatgagatcgcagtccacggcaccaccttggtgtgggagcttaaagaagacggcaccatcgagcattacaccatcgagcctgaggaccttggccttggccgctacacccttgaggatctcgtaggtggcctcggcactgagaacgccgaagctatgcgcgctactttcgcgggcaccggccctgatgcacaccgtgatgcgttggctgcgtccgcaggtgcgatgttctacctcaacggcgatgtcgactccttgaaagatggtgcacaaaaggcgctttccttgcttgccgacggcaccacccaggcatggttggccaagcacgaagagatcgattactcagaaaaggagtcttccaatgactagtaataatctgcccacagtgt

SEQ ID NO: 416 - protein, 207 aa, Corynebacterium glutamicum
AVKWFEASNFTFLFAPAYNPAIAHVQPVRQALKFPTIFNTLGPLLSPARPERQIMGVANANHGQLIAEVFRELGRTRALVVHGAGTDEIAVHGTTLVWELKEDGTIEHYTIEPEDLGLGRYTLEDLVGGLGTENAEAMRATFAGTGPDAHRDALAASAGAMFYLNGDVDSLKDGAQKALSLLADGTTQAWLAKHEEIDYSEKESSND

SEQ ID NO: 417 - DNA, 611 bp, Corynebacterium glutamicum
  CDS (1)..(588): FRXA00954
ttcctgttcgcacctgcgtacaaccctgcgattgcgcatgtgcagccggttcgccaggcgctgaaattccccaccatcttcaacacgcttggaccattgctgtccccggcgcgcccggagcgtcagatcatgggcgtggccaatgccaatcatggacagctcatcgccgaggtcttccgcgagttgggccgtacacgcgcgcttgttgtgcatggcgcaggcaccgatgagatcgcagtccacggcaccaccttggtgtgggagcttaaagaagacggcaccatcgagcattacaccatcgagcctgaggaccttggccttggccgctacacccttgaggatctcgtaggtggcctcggcactgagaacgccgaagctatgcgcgctactttcgcgggcaccggccctgatgcacaccgtgatgcgttggctgcgtccgcaggtgcgatgttctacctcaacggcgatgtcgactccttgaaagatggtgcacaaaaggcgctttccttgcttgccgacggcaccacccaggcatggttggccaagcacgaagagatcgattactcagaaaaggagtcttccaatgactagtaataatctgcccacagtgt

SEQ ID NO: 418 - protein, 196 aa, Corynebacterium glutamicum
FLFAPAYNPAIAHVQPVRQALKFPTIFNTLGPLLSPARPERQIMGVANANHGQLIAEVFRELGRTRALVVHGAGTDEIAVHGTTLVWELKEDGTIEHYTIEPEDLGLGRYTLEDLVGGLGTENAEAMRATFAGTGPDAHRDALAASAGAMFYLNGDVDSLKDGAQKALSLLADGTTQAWLAKHEEIDYSEKESSND

SEQ ID NO: 419 - DNA, 1677 bp, Corynebacterium glutamicum
  CDS (101)..(1654): RXN00957
aaccggcaagccctggatcgaatgaagctcgcagcgagtaattatttgatgtttcccagaaaggcttcagccccacaatgatttcctcggtaggtgccccatgagcacgaatccccatgttttctccctagatgtccgctatcacgaggatgcttctgcattgtttgcccacttgggtggcacaaccgcagatgatgcagccctgttggaaagcgctgatatcaccaccaagaatggtatttcttccctcgcggtgttgaagagttcggtgcgcattacgtgcacgggcaacacggtggtaacgcagccgctgacggactcgggtagggcagtggttgcgcgcctaacgcagcagcttggccagtacaacaccgcagagaacacctttagcttccccgcctcagatgcggttgatgagcgcgagcgcctcaccgcaccaagcaccatcgaagtgctgcgcaagttgcagttcgagtccggttacagcgacgcgtccctgccactgctcatgggcggtttcgcgtttgatttcttagaaacctttgaaacgctccccgctgtcgaggagagcgtcaacacttaccccgattaccagttcgtcctcgcggaaatcgtcctggacatcaatcaccaggaccagaccgccaaactcgccggcgtctccaacgccccaggcgagctcgaggccgagctcaacaagctttcattgcttatcgacgccgccctccccgcaaccgaacacgcctaccaaaccacccctcacgacggcgacactcttcgcgttgtggctgatattcccgatgctcagttccgcacccagatcaatgagctgaaagaaaacatttacaacggtgacatctaccaagttgtcccggcgcgcactttcaccgcaccatgtcctgatgcattcgctgcttatctgcagctgcgtgccaccaacccgtcgccgtacatgttctatatccgtggcctcaacgaaggccgctcctatgaactttttggcgcatcccctgagtccaacctcaagttcaccgctgctaaccgtgagctgcagctgtacccaatcgcaggtacccgcccccgtggactcaacccagatggctccatcaacgatgagctagatatccgcaatgagttggatatgcgcactgatgccaaagagatcgcggagcacaccatgcttgtcgatctcgcccgcaacgacctggcccgcgtctcggtcccagcgtcgcgccgggttgcggatcttttgcaggtggatcgctattcccgcgtgatgcacttggtgtcccgtgtgacggcgacgttggacccagagcttgatgctttggacgcctatcgggcgtgcatgaatatgggcacgttgaccggcgctccgaagttgcgcgctatggagctgttgcgcggcgtcgaaaagcgcaggcgtggttcttatggtggggcagtggggtacctgcgcggcaatggcgatatggataattgcattgttattcgttcggcgtttgtccaggatggtgtggctgctgtgcaggctggtgctggtgtggtccgcgattctaatcctcaatctgaagccgatgagacgttgcacaaggcgtatgccgtgttgaatgccattgcgcttgctgctggttccactttggaggtcatccgatgacacacgttgttctcattgat

SEQ ID NO: 420 - protein, 518 aa, Corynebacterium glutamicum
MSTNPHVFSLDVRYHEDASALFAHLGGTTADDAALLESADITTKNGISSLAVLKSSVRITCTGNTVVTQPLTDSGRAVVARLTQQLGQYNTAENTFSFPASDAVDERERLTAPSTIEVLRKLQFESGYSDASLPLLMGGFAFDFLETFETLPAVEESVNTYPDYQFVLAEIVLDINHQDQTAKLAGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRGLNEGRSYELFGASPESNLKFTAANRELQLYPIAGTRPRGLNPDGSINDELDIRNELDMRTDAKEIAEHTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVIR

SEQ ID NO: 421 - DNA, 1151 bp, Corynebacterium glutamicum
  CDS (1)..(1128): FRXA00957
gatttcttagaaacctttgaaacgctccccgctgtcgaggagagcgtcaacacttaccccgattaccagttcgtcctcgcggaaatcgtcctggacatcaatcaccaggaccagaccgccaaactcgccggcgtctccaacgccccaggcgagctcgaggccgagctcaacaagctttcattgcttatcgacgccgccctccccgcaaccgaacacgcctaccaaaccacccctcacgacggcgacactcttcgcgttgtggctgatattcccgatgctcagttccgcacccagatcaatgagctgaaagaaaacatttacaacggtgacatctaccaagttgtcccggcgcgcactttcaccgcaccatgtcctgatgcattcgctgcttatctgcagctgcgtgccaccaacccgtcgccgtacatgttctatatccgtggcctcaacgaaggccgctcctatgaactttttggcgcatcccctgagtccaacctcaagttcaccgctgctaaccgtgagctgcagctgtacccaatcgcaggtacccgcccccgtggactcaacccagatggctccatcaacgatgagctagatatccgcaatgagttggatatgcgcactgatgccaaagagatcgcggagcacaccatgcttgtcgatctcgcccgcaacgacctggcccgcgtctcggtcccagcgtcgcgccgggttgcggatcttttgcaggtggatcgctattcccgcgtgatgcacttggtgtcccgtgtgacggcgacgttggacccagagcttgatgctttggacgcctatcgggcgtgcatgaatatgggcacgttgaccggcgctccgaagttgcgcgctatggagctgttgcgcggcgtcgaaaagcgcaggcgtggttcttatggtggggcagtggggtacctgcgcggcaatggcgatatggataattgcattgttattcgttcggcgtttgtccaggatggtgtggctgctgtgcaggctggtgctggtgtggtccgcgattctaatcctcaatctgaagccgatgagacgttgcacaaggcgtatgccgtgttgaatgccattgcgcttgctgctggttccactttggaggtcatccgatgacacacgttgttctcattgat

SEQ ID NO: 422 - protein, 376 aa, Corynebacterium glutamicum
DFLETFETLPAVEESVNTYPDYQFVLAEIVLDINHQDQTAKLAGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRGLNEGRSYELFGASPESNLKFTAANRELQLYPIAGTRPRGLNPDGSINDELDIRNELDMRTDAKEIAEHTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVIR

SEQ ID NO: 423 - DNA, 1068 bp, Corynebacterium glutamicum
  CDS (101)..(1045): RXA02687
caaaaccatgctcggcgggggagagttgggccaagcggttcgctaattgagcaacagacatggacacccaccttagttcggcgggttaagctgtgtaaccatgagcgacgcaccaactgttgtggcctatttggggcctgccggaaccttcaccgaagaagccctctacaaatttgccgacgccggcgtattcggcgacggtgagatcgagcagctaccagccaaatcgccacaagaagctgtcgacgccgtccgccacggcaccgcccagttcgcggtggtcgccatcgaaaacttcgtcgacggccccgtcacccccaccttcgacgcccttgaccagggctccaacgtgcaaatcatcgccgaagaagaactcgacatcgccttttccatcatggtccggccagggacttcgcttgccgacgtcaaaaccctcgccacccacccggttgggtaccaacaagtgaaaaactggatggcaaccaccattccggacgccatgtatctttcagcaagctccaacggcgccggcgcacaaatggttgccgaaggaaccgccgacgcagccgcagcgccctcccgcgcagccgaactcttcggactggaacgccttgttgatgatgtcgccgacgtccgtggcgcccgcacccgcttcgttgctgtccaagcccaagcagccgtttccgaaccgaccggccacgaccgcacctccgtcattttctccctaccgaatgtgccaggcagcctcgtgcgcgccctcaacgaattcgccatccgcggcgttgacctcacccgcatcgaatcccgccccacccgcaaagtcttcggaacctaccgcttccacctggacatatccggacatatccgcgatatccccgtcgccgaagccctccgcgcactccacctccaagccgaagaactcgtcttcgtcggctcctggccctccaaccgtgcggaagacagcacgccccaaaccgaccaactagctaagctacacaaggcggacgaatgggttcgcgcagcaagcgaaggaaggaaacttaactagccatggccggccggattatt

SEQ ID NO: 424 - protein, 315 aa, Corynebacterium glutamicum
MSDAPTVVAYLGPAGTFTEEALYKFADAGVFGDGEIEQLPAKSPQEAVDAVRHGTAQFAVVAIENFVDGPVTPTFDALDQGSNVQIIAEEELDIAFSIMVRPGTSLADVKTLATHPVGYQQVKNWMATTIPDAMYLSASSNGAGAQMVAEGTADAAAAPSRAAELFGLERLVDDVADVRGARTRFVAVQAQAAVSEPTGHDRTSVIFSLPNVPGSLVRALNEFAIRGVDLTRIESRPTRKVFGTYRFHLDISGHIRDIPVAEALRALHLQAEELVFVGSWPSNRAEDSTPQTDQLAKLHKADEWVRAASEGRKLN

SEQ ID NO: 425 - DNA, 1353 bp, Corynebacterium glutamicum
  CDS (101)..(1330): RXN01698
cgctagtgcctgcagttatgtcgctttttgacgtcgaaaagcaattttaaaaagcccttggggtgggctggatacgtcttctgcggcctttcgtgcgataatgctaggcatgcttcgatggactacagcaggtgaatcccacggccaggcgcttatcgccacggttgaacacatgccagcaggcgtgcccgtgactaaagatgaggtctcgtatcaattggcgcgccgacgccttggatatggtcgcggcgctcgcatgaagtttgagcaagacgcgttgaccttcctcaccggcatccgccacggcctcactttgggtagccccatctcaatcatgatcggcaacactgagtgggataagtggaccaccatcatgtcctctgacgctttggacatggaagacccagataacgttgcggcgatgtcttcgggtcggggcgcaaaactgactcgtccgcgtccaggccacgctgattacgcaggcatgctcaagtacggattcgatgatgcccgcaacgtgctggagcgttcttcagcccgtgagacggcagcacgcgtggcagcagcaaccgttgcgcgttccttcctgcgtgaaaccttgggcgtggaagtgctttcccacgtaatttccattggtgcgtccgagccttacactggcgcggagccaacctttgcagatattcaagcaatcgatgattccccagttcgtgcattcggtaaagacgctgaagaatccatgatcgcggaaatcgaggccgcaaagaaagccggcgataccctcggtggcatcgtggaagtgattgttgaaggcctgcccatcggtttgggctcacacatttctggcgaagatcgcctcgatgcgcagatcgcagctgcactcatgggcattcaggccatcaagggcgtggaaatcggtgacggtttcgaagaagctcgtcgacgtggctccgaagcccacgatgaagtgttcctggatgacaacggcgtataccgcaacaccaaccgtgcaggtggcctcgaaggcggcatgaccaacggtgaaaccctgcgcgttcgtgctggcatgaagccaatttctactgtgcctcgcgccctgaaaaccattgatatggaaaacggcaaggcagcaaccggaatccaccagcgttccgacgtgtgcgctgttccagccgccggtgtcgttgcagaagcaatggtcaccctggttctcgcccgcgcagtcctgcagaaattcggcggtgactccctgagcgaaaccaagagcaacattgacacctacctcaaaaacattgaggaacgaatgaaattcgaaggtttagaggatggagcgtaatgaagtgaatgatcaaattc

SEQ ID NO: 426 - protein, 410 aa, Corynebacterium glutamicum
MLGMLRWTTAGESHGQALIATVEHMPAGVPVTKDEVSYQLARRRLGYGRGARMKFEQDALTFLTGIRHGLTLGSPISIMIGNTEWDKWTTIMSSDALDMEDPDNVAAMSSGRGAKLTRPRPGHADYAGMLKYGFDDARNVLERSSARETAARVAAATVARSFLRETLGVEVLSHVISIGASEPYTGAEPTFADIQAIDDSPVRAFGKDAEESMIAEIEAAKKAGDTLGGIVEVIVEGLPIGLGSHISGEDRLDAQIAAALMGIQAIKGVEIGDGFEEARRRGSEAHDEVFLDDNGVYRNTNRAGGLEGGMTNGETLRVRAGMKPISTVPRALKTIDMENGKAATGIHQRSDVCAVPAAGVVAEAMVTLVLARAVLQKFGGDSLSETKSNIDTYLKNIEERMKFEGLEDGA

SEQ ID NO: 427 - DNA, 1013 bp, Corynebacterium glutamicum
  CDS (1)..(990): FRXA01698
ggcaacactgagtgggataagtggaccaccatcatgtcctctgacgctttggacatggaagacccagataacgttgcggcgatgtcttcgggtcggggcgcaaaactgactcgtccgcgtccaggccacgctgattacgcaggcatgctcaagtacggattcgatgatgcccgcaacgtgctggagcgttcttcagcccgtgagacggcagcacgcgtggcagcagcaaccgttgcgcgttccttcctgcgtgaaaccttgggcgtggaagtgctttcccacgtaatttccattggtgcgtccgagccttacactggcgcggagccaacctttgcagatattcaagcaatcgatgattccccagttcgtgcattcggtaaagacgctgaagaatccatgatcgcggaaatcgaggccgcaaagaaagccggcgataccctcggtggcatcgtggaagtgattgttgaaggcctgcccatcggtttgggctcacacatttctggcgaagatcgcctcgatgcgcagatcgcagctgcactcatgggcattcaggccatcaagggcgtggaaatcggtgacggtttcgaagaagctcgtcgacgtggctccgaagcccacgatgaagtgttcctggatgacaacggcgtataccgcaacaccaaccgtgcaggtggcctcgaaggcggcatgaccaacggtgaaaccctgcgcgttcgtgctggcatgaagccaatttctactgtgcctcgcgccctgaaaaccattgatatggaaaacggcaaggcagcaaccggaatccaccagcgttccgacgtgtgcgctgttccagccgccggtgtcgttgcagaagcaatggtcaccctggttctcgcccgcgcagtcctgcagaaattcggcggtgactccctgagcgaaaccaagagcaacattgacacctacctcaaaaacattgaggaacgaatgaaattcgaaggtttagaggatggagcgtaatgaagtgaatgatcaaattc

SEQ ID NO: 428 - protein, 330 aa, Corynebacterium glutamicum
GNTEWDKWTTIMSSDALDMEDPDNVAAMSSGRGAKLTRPRPGHADYAGMLKYGFDDARNVLERSSARETAARVAAATVARSFLRETLGVEVLSHVISIGASEPYTGAEPTFADIQAIDDSPVRAFGKDAEESMIAEIEAAKKAGDTLGGIVEVIVEGLPIGLGSHISGEDRLDAQIAAALMGIQAIKGVEIGDGFEEARRRGSEAHDEVFLDDNGVYRNTNRAGGLEGGMTNGETLRVRAGMKPISTVPRALKTIDMENGKAATGIHQRSDVCAVPAAGVVAEAMVTLVLARAVLQKFGGDSLSETKSNIDTYLKNIEERMKFEGLEDGA

SEQ ID NO: 429 - DNA, 906 bp, Corynebacterium glutamicum
  CDS (101)..(883): RXA01095
gaaaccccaggtcaaagctagggtgtggcaccctgatttctttcgccatgtgtgttcgggataaccttaaacacagcattggttggaaggaggttggggcatggttgcaacagagaaccgcatgttgatggaaatcgctgcggaaatatcggctcgggaagcaacgcttggttttcaagaagtcaaaactaaatctcgatcagcaggtctcacggcggctttcgatattgcttcagtctttttttcgtctggatgtaatgtcgtagtcgcctttgatcgttttgcatccaattggtctgatcattcggatcatgtggactacgctgcacaggttgcgggttttggcgcatcaatgcttgcatatacggtgcgcaggggacagtttgataccgcagtacgcgatatcagggacatcaaatctgaagtagacattcccattctgcttcatgatcccatcatcgatccgtatcaaatccacgaagcccgcgtcatgggcatcgacgctcttcaattccccgtatgggcgatggaacaagctcgactggaatctttggtggaccgcaccgaatcattgggcatgacagccatcgtgtctgtgcgaaaccacgaagaagcgcatcgtgcagtggacgcaggagcgacagtggtagcaattgatattactggttataccggctcactcactttgcctgaagcgttttcgggtatcacccaattcatgcccaaagaggtagcccgcattgtgctcggaggttgcagcagccctaaagaactcatgcggtttgcacgacattctgcagacgccatctttgttccacatgcagacctcgccaccacaaaatctcttgtgacagcaggtatgcatccagcgtgcccatcgcgttgaagaggtgctctgtggtcagc

SEQ ID NO: 430 - protein, 261 aa, Corynebacterium glutamicum
MVATENRMLMEIAAEISAREATLGFQEVKTKSRSAGLTAAFDIASVFFSSGCNVVVAFDRFASNWSDHSDHVDYAAQVAGFGASMLAYTVRRGQFDTAVRDIRDIKSEVDIPILLHDPIIDPYQIHEARVMGIDALQFPVWAMEQARLESLVDRTESLGMTAIVSVRNHEEAHRAVDAGATVVAIDITGYTGSLTLPEAFSGITQFMPKEVARIVLGGCSSPKELMRFARHSADAIFVPHADLATTKSLVTAGMHPACPSR

SEQ ID NO: 431 - DNA, 1545 bp, Corynebacterium glutamicum
  CDS (101)..(1522): RXA00955
gatggtgcacaaaaggcgctttccttgcttgccgacggcaccacccaggcatggttggccaagcacgaagagatcgattactcagaaaaggagtcttccaatgactagtaataatctgcccacagtgttggaaagcatcgtcgagggtcgtcgcggacacctggaggaaattcgcgctcgcatcgctcacgtggatgtggatgcgcttccaaaatccacccgttctctgtttgattccctcaaccagggtaggggaggggcgcgtttcatcatggagtgcaagtccgcatcgccttctttgggaatgattcgtgagcactaccagccgggtgaaatcgctcgcgtgtactctcgctacgccagcggcatttccgtgctgtgcgagccggatcgttttggtggcgattacgatcacctcgctaccgttgccgctacctctcatcttccggtgctgtgcaaagacttcatcattgatcctgtccaggtacacgcggcgcgttactttggtgctgatgccatcctgctcatgctctctgtgcttgatgatgaagagtacgcagcactcgctgccgaggctgcgcgttttgatctggatatcctcaccgaggttattgatgaggaggaagtcgcccgcgccatcaagctgggtgcgaagatctttggcgtcaaccaccgcaacctgcatgatctgtccattgatttggatcgttcacgtcgcctgtccaagctcattccagcagatgccgtgctcgtgtctgagtctggcgtgcgcgataccgaaaccgtccgccagctaggtgggcactccaatgcattcctcgttggctcccagctgaccagccaggaaaacgtcgatctggcagcccgcgaattagtctacggccccaacaaagtctgcggactcacctcaccaagtgcagcacaaaccgctcgcgcagcgggtgcggtctacggcgggctcatcttcgaagaggcatcgccacgcaatgtttcacgtgaaacattgcaaaaaatcatcgccgcagagcccaacctgcgctacgtcgcggtcagccgtcgcacctccgggtacaaggatttgcttgtcgacggcatcttcgccgtacaaatccacgccccactgcaggacagcgtcgaagcagaaaaggcattgatcgccgccgttcgtgaagaggttggaccgcaggtccaggtctggcgcgcgatctcgatgtccagccccttgggggctgaagtggcagctgcggtggagggtgacgtcgataagctaattcttgatgcccatgaaggtggcagcggggaagtattcgactgggctacggtgccggccgctgtgaaggcaaagtctttgctcgcgggaggcatctctccggacaacgctgcgcaggcactcgctgtgggctgcgcaggtttggacatcaactctggcgtggaataccccgccggtgcaggcacgtgggctggggcgaaagacgccggcgcgctgctgaaaattttagcgaccatctccacattccattactaaaggtttaaataggatcatga

SEQ ID NO: 432 - protein, 474 aa, Corynebacterium glutamicum
MTSNNLPTVLESIVEGRRGHLEEIRARIAHVDVDALPKSTRSLFDSLNQGRGGARFIMECKSASPSLGMIREHYQPGEIARVYSRYASGISVLCEPDRFGGDYDHLATVAATSHLPVLCKDFIIDPVQVHAARYFGADAILLMLSVLDDEEYAALAAEAARFDLDILTEVIDEEEVARAIKLGAKIFGVNHRNLHDLSIDLDRSRRLSKLIPADAVLVSESGVRDTETVRQLGGHSNAFLVGSQLTSQENVDLAARELVYGPNKVCGLTSPSAAQTARAAGAVYGGLIFEEASPRNVSRETLQKIIAAEPNLRYVAVSRRTSGYKDLLVDGIFAVQIHAPLQDSVEAEKALIAAVREEVGPQVQVWRAISMSSPLGAEVAAAVEGDVDKLILDAHEGGSGEVFDWATVPAAVKAKSLLAGGISPDNAAQALAVGCAGLDINSGVEYPAGAGTWAGAKDAGALLKILATISTFHY

SEQ ID NO: 433 - DNA, 494 bp, Corynebacterium glutamicum
  CDS (1)..(471): RXA02814
gccaaaaacctagaagaacactcctacgtggtcaaccacctgcgcaccatcctggaaccactgtgctcacaattcgacgccccaacagttcctgaactgaccaaaaccaacgaaatgtggcacctcgcaacacccatcgttggcaccctcaagtacccacacatcaccgcactagaactagccatacgaacacaccccacccccgcgatctgtggcacccccaccgacgccgccgaagccctcatcatcgaagcggaatccccccgaaacttctacgccggagcagccggctggtgtgactccaccggagacggcgaatacatggtagccatccgctgcgccgaagtatccgaagacggaacctgggccagagcatgggcaggcggaggcatcgtcgccgaatcagacgcccaagaagagtttgatgaaaccaccgcgaagctccaaaccatcatgcgctcgcttggtttgtgagatgtggtcttaaaacaccg

SEQ ID NO: 434 - protein, 157 aa, Corynebacterium glutamicum
AKNLEEHSYVVNHLRTILEPLCSQFDAPTVPELTKTNEMWHLATPIVGTLKYPHITALELAIRTHPTPAICGTPTDAAEALIIEAESPRNFYAGAAGWCDSTGDGEYMVAIRCAEVSEDGTWARAWAGGGIVAESDAQEEFDETTAKLQTIMRSLGL

SEQ ID NO: 435 - DNA, 803 bp, Corynebacterium glutamicum
  CDS (1)..(780): RXA00229
gaggcgaaaggcctcgcgcagggacgtgcgacggtgtacaggcgcatcgacacgcttgggtcgcgtgcttccgggcaagatttaaatacgcttctcgacgccgccctctaccttggcttcagcggcctgaacatcactcacccgtacaagcaagcagtattacccctgcttggcgaagtctccgaacaagccacccaactcggcgcagtgaatactgtcgttatggacgccaccggccacaccaccggccacaacaccgacgtctccggatttggccgcggaatggaagaaggcctccccaacgccaagctcgattccgtcgtgcaggtcggcgccggcggcgtagaaaacgcagtggcatacgccctggtcacccacggtgtgcagaaacttcaggtcgctgacctcgacacttcccgcgcgcaggcactggcagatgtcatcaacaacgcagtcggccgtgaagccgtcgtgggagtagacgcccgcggcatcgaagacgtcatcgccgccgccgacggagtagtcaacgcaacccccatgggaatgccagcacaccccggcaccgcctttgatgtcagctgcctcaccaaggatcactgggttggcgacgtcgtgtacatgcccatcgaaactgaacttctcaaagccgcccgtgccctcggctgcgaaaccctcgacggaacccgcatggcaatccaccaagccgtcgatgccttccgactgttcaccggcctcgaacccgacgtctcccgcatgcgggaaactttcctgtccctctaaaagagtcagtaaaacctcga

SEQ ID NO: 436 - protein, 260 aa, Corynebacterium glutamicum
EAKGLAQGRATVYRRIDTLGSRASGQDLNTLLDAALYLGFSGLNITHPYKQAVLPLLGEVSEQATQLGAVNTVVMDATGHTTGHNTDVSGFGRGMEEGLPNAKLDSVVQVGAGGVENAVAYALVTHGVQKLQVADLDTSRAQALADVINNAVGREAVVGVDARGIEDVIAAADGVVNATPMGMPAHPGTAFDVSCLTKDHWVGDVVYMPIETELLKAARALGCETLDGTRMAIHQAVDAFRLFTGLEPDVSRMRETFLSL

SEQ ID NO: 437 - DNA, 927 bp, Corynebacterium glutamicum
  CDS (101)..(904): RXA02093
ggcaggaatttcccgaaaacttccaccaataatcaagccatatcccacacaatcaggcatttgctcttcctttgctccgcatgagtataaaatcactgtcatggtcaactacgtcgacagggaaacaaccctgtgcatctctctcgctgctcgtccatccaaccatggtgttcgtttccacaactggctttacgctgaacttggattgaactacctgtacaaggctgttgccccagcagatatcaccgctgcagtcgcaggtatccgtggtctgaacattcgcggcgcaggtgtctccatgccatacaagagcgatgtcatcccactcatcgatgagttgcatccttccgcagagcgcatacgttctgttaacaccatcgtcaacaatgacggacaccttgtcggatacaacaccgactacactgcggtgtaccacctccttgaagaacaccgcgtgaaccccaatgcacgagtagctatcaagggatccggcggcatggccaatgctgttgttgcagctcttgctgagtatggtctgagtggcaccgtcgttgcccgcaaccacaccaccggttctgcgctagcttcccgttacggttgggaatactccgcaactgttccggaagacgcaaaaattttggttaatgtaaccccaatgggaatgaatggacctgaccaagacgttgtatcttttggtgaggatgaagtagaccgagccgacgtaatctttgactgcgtagcattccccgtcgagaccccactgattaagttggccaaggaaaagggtaagcaaaccatcgacggcggagaagttgccgctcttcaggcagcagagcagttccacctctacaccggagttcttccaaccaacgaccagatcattgctgcggaggagttctccaagtaaatttctctcccctattttta

SEQ ID NO: 438 - protein, 268 aa, Corynebacterium glutamicum
MVNYVDRETTLCISLAARPSNHGVRFHNWLYAELGLNYLYKAVAPADITAAVAGIRGLNIRGAGVSMPYKSDVIPLIDELHPSAERIRSVNTIVNNDGHLVGYNTDYTAVYHLLEEHRVNPNARVAIKGSGGMANAVVAALAEYGLSGTVVARNHTTGSALASRYGWEYSATVPEDAKILVNVTPMGMNGPDQDVVSFGEDEVDRADVIFDCVAFPVETPLIKLAKEKGKQTIDGGEVAALQAAEQFHLYTGVLPTNDQIIAAEEFSK

SEQ ID NO: 439 - DNA, 951 bp, Corynebacterium glutamicum
  CDS (101)..(928): RXA02791
accgtgttcaacgacaccttcgaagagcacgaagccgacattgagcaagctttgaacagtggcgttctagacagcaaccgataaggatcagcgaataaaattgggttctcacatcactcaccgggcggccgtactcggctcacccatcgagcattccaaatccccagtcctccacaacaccggctataaagccctcggactggaccaatgggaatacgaccgctttgagtgcaccggcgacatgctccccggcatcgtctccggcgctgatgaaacctactgcggattctccgtcaccatgccgtctaaattcgcagctcttgaattcgccgacgaagtaaccgaacgcgcctgcgccatcggctccgcaaacaccttgctgcgcacggccaccggatggcgcgccgacaacaccgacgtcgacggcatcaggggagctctcggtgaactcctcggcggcgcatcactggccggcaaacacgccatcgtcatcggctccggcggcaccgcacgccccgccatctgggcactcatcgaagccggggtcgcccggatcacggtgctcaaccgctccgatcgcaccgccgaactgcaaacgcttttcgacgaaacccccaccaccttggcctacgccccgctcgagcatctccacatcgaagccgacgtcgtagtctctacagtgccctccgcagcaatcgcaggcctcgaagacacccttgcgatcgccccagtcctcgacgtcatctacgacccctggccaacaccactcgtagaagtcacacgagccaaaggcctcaaagctgtcggaggccacgtcatgctggcacaccagtcctacggacagtttgaacaattcaccggaatggatgcaccccgcgatgccatgcgtgaggctttggaagagtctttaggcatctcagaagaacactaagtccccgccacctcctcaac

SEQ ID NO: 440 - protein, 276 aa, Corynebacterium glutamicum
LGSHITHRAAVLGSPIEHSKSPVLHNTGYKALGLDQWEYDRFECTGDMLPGIVSGADETYCGFSVTMPSKFAALEFADEVTERACAIGSANTLLRTATGWRADNTDVDGIRGALGELLGGASLAGKHAIVIGSGGTARPAIWALIEAGVARITVLNRSDRTAELQTLFDETPTTLAYAPLEHLHIEADVVVSTVPSAAIAGLEDTLAIAPVLDVIYDPWPTPLVEVTRAKGLKAVGGHVMLAHQSYGQFEQFTGMDAPRDAMREALEESLGISEEH

SEQ ID NO: 441 - DNA, 693 bp, Corynebacterium glutamicum
  CDS (101)..(670): RXA01699
ctgcagaaattcggcggtgactccctgagcgaaaccaagagcaacattgacacctacctcaaaaacattgaggaacgaatgaaattcgaaggtttagaggatggagcgtaatgaagtgaatgatcaaattcacttagatcatcaatcagatgacacctctgaatgctcctgcccgatcgtggttcttgtgggtttgccaggagctggaaaatccaccattggacgtcgattagcgcgcgccttaaacactgaactcgtcgactccgacgaactgattgagcgcgccaccggaaaagcctgtggcgccgtgttcagcgagctcggcgagccagccttccgcgagctcgaggccatccacgtggccgaagcactgaaatcctccggagtggtgagcttgggaggcggatctgtgctgacagaatccacccgtgaactgctcaaaggccaggacgtggtctggatcgacgtgccagtagaagaaggcatcaggcgcaccgcaaacgagcgttcccgccccgtgctgcaagccgccgaccccgccgagcactaccgcaacctggtgaaagtgcgcaccccgttgtacgaagaggtggcaacctaccgacttcgcaccaacaaccgcagcccccagcaagtggtggcagcagtgttgcatcatctagaaatcgattaattaaaccgggcacctgatta

SEQ ID NO: 442 - protein, 190 aa, Corynebacterium glutamicum
MERNEVNDQIHLDHQSDDTSECSCPIVVLVGLPGAGKSTIGRRLARALNTELVDSDELIERATGKACGAVFSELGEPAFRELEAIHVAEALKSSGVVSLGGGSVLTESTRELLKGQDVVWIDVPVEEGIRRTANERSRPVLQAADPAEHYRNLVKVRTPLYEEVATYRLRTNNRSPQQVVAAVLHHLEID

SEQ ID NO: 443 - DNA, 959 bp, Corynebacterium glutamicum
  CDS (97)..(936): RXA00952
catcctcgtctccctatccggccgtggcgacaaggacgttgaccacgtgcgccgcaccctcgaagaaaatccagaactgatcctgaaggacaaccgatgagccgttacgacgatctttttgcacgcctcgacacggcaggggagggcgcctttgttcccttcatcatgctgagcgacccttcaccagaggaggctttccagatcatctccacagcaatcgaagctggcgcagatgcactggaacttggcgtacctttctccgacccagttgccgatggccccaccgtcgcggaatcccacctccgcgcactcgacggcggcgccaccgtagacagcgcactcgagcagatcaagcgcgtgcgcgcagcctacccagaggttcccatcggaatgctcatctacggcaacgttcctttcacccgtggcttggatcgcttctaccaagagttcgctgaagctggcgcagactccatcctcctgccagacgtcccagtccgagaaggcgcaccgttttctgcagcagctgcagcagccggaattgatcccatttacatcgctccggccaacgccagcgagaaaaccctcgagggtgtctccgccgcatcaaagggctacatctacgccatctcccgcgacggcgtcaccggcaccgaacgtgaatcatccaccgacggcctgtccgcagtggtggacaacatcaagaaatttgatggcgcacccatcctcttgggcttcggcatctcatcccctcagcacgtggcagacgcgattgcagcgggtgcttccggtgcgatcacgggttccgcgatcaccaagatcattgcttcccactgcgaaggtgagcacccgaacccgtccaccattcgagatatggacggtttgaagaaggatctcactgagttcatctctgcgatgaaggcagcgaccaagaaggtttaggcctttaaatgtggcaatgt

SEQ ID NO: 444 - protein, 280 aa, Corynebacterium glutamicum
MSRYDDLFARLDTAGEGAFVPFIMLSDPSPEEAFQIISTAIEAGADALELGVPFSDPVADGPTVAESHLRALDGGATVDSALEQIKRVRAAYPEVPIGMLIYGNVPFTRGLDRFYQEFAEAGADSILLPDVPVREGAPFSAAAAAAGIDPIYIAPANASEKTLEGVSAASKGYIYAISRDGVTGTERESSTDGLSAVVDNIKKFDGAPILLGFGISSPQHVADAIAAGASGAITGSAITKIIASHCEGEHPNPSTIRDMDGLKKDLTEFISAMKAATKKV

SEQ ID NO: 445 - DNA, 1237 bp, Corynebacterium glutamicum
  CDS (101)..(1237): RXN00956
gccggtgcaggcacgtgggctggggcgaaagacgccggcgcgctgctgaaaattttagcgaccatctccacattccattactaaaggtttaaataggatcatgactgaaaaagaaaacttgggcggctccacgctgctgcctgcatacttcggtgaattcggcggccagttcgtcgcggaatccctcctgcctgctctcgaccagctggagaaggccttcgttgacgcgaccaacagcccagagttccgcgaagaactcggcggctacctccgcgattacctcggccgcccaaccccgctgaccgaatgctccaacctgccactcgcaggcgaaggcaaaggctttgcgcggatcttcctcaagcgcgaagacctcgtccacggcggtgcacacaaaactaaccaggtgatcggccaggtgctgcttgccaagcgcatgggcaaaacccgcatcatcgcagagaccggcgcaggccagcacggcaccgccaccgctctcgcatgtgcgctcatgggcctcgagtgcgttgtctacatgggcgccaaggacgttgcccgccagcagcccaacgtctaccgcatgcagctgcacggcgcgaaggtcatccccgtggaatctggttccggcaccctgaaggacgccgtgaatgaagcgctgcgcgattggaccgcaaccttccacgagtcccactaccttctcggcacccccgccggcccgcacccattcccaaccatcgtgcgtgaattccacaaggtgatctctgaggaagccaaggcacagatgctagagcgcaccggcaagcttcccgacgttgtggtcgcctgtgtcggtggtggctccaacgccatcggcatgttcgcagacttcattgacgatgaaggtgtagagctcgtcggcgctgagccagccggtgaaggcctcgactccggcaagcacggcgcaaccatcaccaacggtcagatcggcatcctgcacggcacccgttcctacctgatgcgcaactccgacggccaagtggaagagtcctactccatctccgccggacttgattacccaggcgtcggcccacagcacgcacacctgcacgccaccggccgcgccacctacgttggtatcaccgacgccgaagccctccaagcattccagtacctcgcccgctacgaaggcatcatccccgcactggaatcctcacacgcgttcgcctacgcactcaagcgcgccaagaccgccgaagta

SEQ ID NO: 446 - protein, 379 aa, Corynebacterium glutamicum
MTEKENLGGSTLLPAYFGEFGGQFVAESLLPALDQLEKAFVDATNSPEFREELGGYLRDYLGRPTPLTECSNLPLAGEGKGFARIFLKREDLVHGGAHKTNQVIGQVLLAKRMGKTRIIAETGAGQHGTATALACALMGLECVVYMGAKDVARQQPNVYRMQLHGAKVIPVESGSGTLKDAVNEALRDWTATFHESHYLLGTPAGPHPFPTIVREFHKVISEEAKAQMLERTGKLPDVVVACVGGGSNAIGMFADFIDDEGVELVGAEPAGEGLDSGKHGATITNGQIGILHGTRSYLMRNSDGQVEESYSISAGLDYPGVGPQHAHLHATGRATYVGITDAEALQAFQYLARYEGIIPALESSHAFAYALKRAKTAEV

SEQ ID NO: 447 - DNA, 1231 bp, Corynebacterium glutamicum
  CDS (101)..(1231): FRXA00956
gccggtgcaggcacgtgggctggggcgaaagacgccggcgcgctgctgaaaattttagcgaccatctccacattccattactaaaggtttaaataggatcatgactgaaaaagaaaacttgggcggctccacgctgctgcctgcatacttcggtgaattcggcggccagttcgtcgcggaatccctcctgcctgctctcgaccagctggagaaggccttcgttgacgcgaccaacagcccagagttccgcgaagaactcggcggctacctccgcgattacctcggccgcccaaccccgctgaccgaatgctccaacctgccactcgcaggcgaaggcaaaggctttgcgcggatcttcctcaagcgcgaagacctcgtccacggcggtgcacacaaaactaaccaggtgatcggccaggtgctgcttgccaagcgcatgggcaaaacccgcatcatcgcagagaccggcgcaggccagcacggcaccgccaccgctctcgcatgtgcgctcatgggcctcgagtgcgttgtctacatgggcgccaaggacgttgcccgccagcagcccaacgtctaccgcatgcagctgcacggcgcgaaggtcatccccgtggaatctggttccggcaccctgaaggacgccgtgaatgaagcgctgcgcgattggaccgcaaccttccacgagtcccactaccttctcggcacccccgccggcccgcacccattcccaaccatcgtgcgtgaattccacaaggtgatctctgaggaagccaaggcacagatgctagagcgcaccggcaagcttcccgacgttgtggtcgcctgtgtcggtggtggctccaacgccatcggcatgttcgcagacttcattgacgatgaaggtgtagagctcgtcggcgctgagccagccggtgaaggcctcgactccggcaagcacggcgcaaccatcaccaacggtcagatcggcatcctgcacggcacccgttcctacctgatgcgcaactccgacggccaagtggaagagtcctactccatctccgccggacttgattacccaggcgtcggcccacagcacgcacacctgcacgccaccggccgcgccacctacgttggtatcaccgacgccgaagccctccaagcattccagtacctcgcccgctacgaaggcatcatccccgcactggaatcctcacacgcgttcgcctacgcactcaagcgcgccaagaccgcc

SEQ ID NO: 448 - protein, 377 aa, Corynebacterium glutamicum
MTEKENLGGSTLLPAYFGEFGGQFVAESLLPALDQLEKAFVDATNSPEFREELGGYLRDYLGRPTPLTECSNLPLAGEGKGFARIFLKREDLVHGGAHKTNQVIGQVLLAKRMGKTRIIAETGAGQHGTATALACALMGLECVVYMGAKDVARQQPNVYRMQLHGAKVIPVESGSGTLKDAVNEALRDWTATFHESHYLLGTPAGPHPFPTIVREFHKVISEEAKAQMLERTGKLPDVVVACVGGGSNAIGMFADFIDDEGVELVGAEPAGEGLDSGKHGATITNGQIGILHGTRSYLMRNSDGQVEESYSISAGLDYPGVGPQHAHLHATGRATYVGITDAEALQAFQYLARYEGIIPALESSHAFAYALKRAKTA

SEQ ID NO: 449 - DNA, 1401 bp, Corynebacterium glutamicum
  CDS (101)..(1378): RXA00064
tcccctaaaacgtctagagtagtggcttgaggtcactgctctttttttgtgcccttttttggtccgtctattttgccaccacatgcggaggtacgcagttatgagttcagtttcgctgcaggattttgatgcagagcgaattggtttgttccacgaggacattaagcgcaagtttgatgagctcaagtcaaaaaatctgaagctggatcttactcgcggtaagccttcgtcggagcagttggatttcgctgatgagttgttggcgttgcctggtaagggtgatttcaaggctgcggatggtactgatgtccgtaactatggcgggctggatggcatcgttgatattcgccagatttgggcggatttgctgggtgttcctgtggagcaggtcttggcgggggatgcttcgagcttgaacatcatgtttgatgtgatcagctggtcgtacattttcggtaacaatgattcggttcagccttggtcgaaggaagaaaccgttaagtggatttgccctgttccgggctatgatcgccatttctccatcacggagcgtttcggctttgagatgatttctgtgccaatgaatgaagacggccctgatatggatgctgttgaggaattggtgaagaatccgcaggttaagggcatgtgggttgttccggtgttttctaacccgactggtttcacggtgacagaagacgtcgcaaagcgtctaagcgcaatggaaaccgcagctccggacttccgcgttgtgtgggataatgcctacgccgttcatacgctgaccgatgaattccctgaggttatcgatatcgtcgggcttggtgaggccgctggcaacccgaaccgtttctgggcgttcacttctacttcgaagatcactctcgcgggtgcgggcgtgtcgttcttcctcacctctgcggagaaccgcaagtggtacaccggccatgcgggtatccgtggcattggccctaacaaggtcaatcagttggctcatgcgcgttactttggcgatgctgagggagtgcgcgcggtgatgcgtaagcatgctgcgtcgttggctccgaagttcaacaaggttctggagattctggattctcgccttgctgagtacggtgtcgcgcagtggactgtccctgcgggcggttacttcatttcccttgatgtggttcctggtacggcgtctcgcgtggctgagttggctaaggaagccggcatcgcgttgacgggtgcgggttcttcttacccgctgcgtcaggatccggagaacaaaaatctccgtttggcaccgtcgctgcctccagttgaggaacttgaggttgccatggatggcgtggctacctgtgtgctgttggcagcagcggagcattacgctaactaaaagtgaatacagcggagaca

SEQ ID NO: 450 - protein, 426 aa, Corynebacterium glutamicum
MSSVSLQDFDAERIGLFHEDIKRKFDELKSKNLKLDLTRGKPSSEQLDFADELLALPGKGDFKAADGTDVRNYGGLDGIVDIRQIWADLLGVPVEQVLAGDASSLNIMFDVISWSYIFGNNDSVQPWSKEETVKWICPVPGYDRHFSITERFGFEMISVPMNEDGPDMDAVEELVKNPQVKGMWVVPVFSNPTGFTVTEDVAKRLSAMETAAPDFRVVWDNAYAVHTLTDEFPEVIDIVGLGEAAGNPNRFWAFTSTSKITLAGAGVSFFLTSAENRKWYTGHAGIRGIGPNKVNQLAHARYFGDAEGVRAVMRKHAASLAPKFNKVLEILDSRLAEYGVAQWTVPAGGYFISLDVVPGTASRVAELAKEAGIALTGAGSSYPLRQDPENKNLRLAPSLPPVEELEVAMDGVATCVLLAAAEHYAN

SEQ ID NO: 451 - DNA, 1143 bp, Corynebacterium glutamicum
  CDS (101)..(1120): RXN00448
ccatttaccttcaactaaggtagccgtaactgcaaagctcaggccatcctcttcagtgttcatagagataaccgtagtaggtatgtgccacacttgtcaggtgactaccaaagacatttcccgcccagtatgcatcctgggcctcggcctcatcggcggatccctcctccgcgacctccatgcagccaaccactccgtcttcggctacaaccgctcacgctccggcgctaaatcagccgtcgacgaaggcttcgacgtttccgccgatcttgaagcaaccctccagcgtgcagccgccgaagatgcgctcatcgtcctcgcggtccccatgaccgcaatcgattcgcttctcgacgccgtccacacccacgcaccaaacaacggcttcaccgacgtcgtatccgtaaaaaccgccgtctacgacgcagtaaaagcccgcaacatgcaacaccgttatgtgggatcccaccccatggcaggcaccgccaactccggctggagcgcatccatggacggactgttcaaacgagcagtatgggtggtcaccttcgaccagcttttcgacggcaccgacatcaactccacctggatcagcatctggaaagacgtcgtccaaatggcactcgccgtgggcgctgaagttgtcccatcccgagttggcccacacgatgcagcagcagcacgagtgtctcatttaacacacatcctggctgaaaccctcgccatcgtcggtgacaacggtggcgcactgtctctctctttagccgctggcagctaccgcgactccacccgcgttgcaggcaccgacccaggactcgtccgcgccatgtgtgaaagcaacgccggcccactggtcaaagccctcgacgaagcactggcgatcctccacgaagcccgcgaaggcctcaccgcagaacagccaaacatcgagcaacttgccgacaacggctaccgatcccgcatccgctacgaagcccgctccggccagcgacgcgccaaagaatccgttagccctaccatcacctcatccaggccagtgctccgtctccacccgggcacaccaaactgggagaagcagctcatccacgctgaaaccctcggcgcacggatcgaagtgttctagttttatcggctgatgattct

SEQ ID NO: 452 - protein, 340 aa, Corynebacterium glutamicum
VTTKDISRPVCILGLGLIGGSLLRDLHAANHSVFGYNRSRSGAKSAVDEGFDVSADLEATLQRAAAEDALIVLAVPMTAIDSLLDAVHTHAPNNGFTDVVSVKTAVYDAVKARNMQHRYVGSHPMAGTANSGWSASMDGLFKRAVWVVTFDQLFDGTDINSTWISIWKDVVQMALAVGAEVVPSRVGPHDAAAARVSHLTHILAETLAIVGDNGGALSLSLAAGSYRDSTRVAGTDPGLVRAMCESNAGPLVKALDEALAILHEAREGLTAEQPNIEQLADNGYRSRIRYEARSGQRRAKESVSPTITSSRPVLRLHPGTPNWEKQLIHAETLGARIEVF

SEQ ID NO: 453 - DNA, 689 bp, Corynebacterium glutamicum
  CDS (1)..(666): FRXA00448
tatgtgggatcccaccccatggcaggcaccgccaactccggctggagcgcatccatggacggactgttcaaacgagcagtatgggtggtcaccttcgaccagcttttcgacggcaccgacatcaactccacctggatcagcatctggaaagacgtcgtccaaatggcactcgccgtgggcgctgaagttgtcccatcccgagttggcccacacgatgcagcagcagcacgagtgtctcatttaacacacatcctggctgaaaccctcgccatcgtcggtgacaacggtggcgcactgtctctctctttagccgctggcagctaccgcgactccacccgcgttgcaggcaccgacccaggactcgtccgcgccatgtgtgaaagcaacgccggcccactggtcaaagccctcgacgaagcactggcgatcctccacgaagcccgcgaaggcctcaccgcagaacagccaaacatcgagcaacttgccgacaacggctaccgatcccgcatccgctacgaagcccgctccggccagcgacgcgccaaagaatccgttagccctaccatcacctcatccaggccagtgctccgtctccacccgggcacaccaaactgggagaagcagctcatccacgctgaaaccctcggcgcacggatcgaagtgttctagttttatcggctgatgattct

SEQ ID NO: 454 - protein, 222 aa, Corynebacterium glutamicum
YVGSHPMAGTANSGWSASMDGLFKRAVWVVTFDQLFDGTDINSTWISIWKDVVQMALAVGAEVVPSRVGPHDAAAARVSHLTHILAETLAIVGDNGGALSLSLAAGSYRDSTRVAGTDPGLVRAMCESNAGPLVKALDEALAILHEAREGLTAEQPNIEQLADNGYRSRIRYEARSGQRRAKESVSPTITSSRPVLRLHPGTPNWEKQLIHAETLGARIEVF

SEQ ID NO: 455 - DNA, 346 bp, Corynebacterium glutamicum
  CDS (101)..(346): FRXA00452
ccatttaccttcaactaaggtagccgtaactgcaaagctcaggccatcctcttcagtgttcatagagataaccgtagtaggtatgtgccacacttgtcaggtgactaccaaagacatttcccgcccagtatgcatcctgggcctcggcctcatcggcggatccctcctccgcgacctccatgcagccaaccactccgtcttcggctacaaccgctcacgctccggcgctaaatcagccgtcgacgaaggcttcgacgtttccgccgatcttgaagcaaccctccagcgtgcagccgccgaagatgcgctcatcgtcctcgcggtccccatgaccgcaatcgattcg

SEQ ID NO: 456 - protein, 82 aa, Corynebacterium glutamicum
VTTKDISRPVCILGLGLIGGSLLRDLHAANHSVFGYNRSRSGAKSAVDEGFDVSADLEATLQRAAAEDALIVLAVPMTAIDS

SEQ ID NO: 457 - DNA, 1248 bp, Corynebacterium glutamicum
  CDS (101)..(1225): RXA00584
tagttgtgccacctaaaacgcgaacagaaccggagtcgagcagcacctccccgcaagggtagaggggctgcttttttgtttcctaaattcaccccatcccatgcatagccctgaaaggcaagaaaaaatgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaagtaattaagggcgctagactgtta

SEQ ID NO: 458 - protein, 375 aa, Corynebacterium glutamicum
MHSPERQEKMSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTIVGWKGLINDPHLNETYDIPEGLRIARKVLIDVVNLDLPVGCEFLEPNSPQYYADTVAWGAIGARTTESQVHRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELAAAVRERRAAAK

SEQ ID NO: 459 - DNA, 1983 bp, Corynebacterium glutamicum
  CDS (101)..(1960): RXA00579
tcgtctaagtttttctttgagttttcatatgtagaaggcatcgtcggcttcggcctggcggtgcttttctcgttgttttgtggttttgtcagaggatgtcatgcgcgttttaattattgataattatgattctttcacgtttaatctcgccacctatgtggaagaggttacgggtcaggcacctgtggtggtgcctaatgatcaagaaatagatgagatgcttttcgacgccgtcatcctctcacctggcccgggccacgccggcgttgcggctgattttggtatctgtgcaggcgtcattgagcgtgcacgcgttccgattttgggtgtgtgtttaggccaccagggcattgcgttggcctatggcggtgatgttgatttggcgcccaggccggtccacggtgaggtttcgcagatcacccatgatggttcaggtttatttgcaggcatccctgaaacgtttgaggcggtgcgttatcactcgatggtggcaacccgcttgccggagtcattgaaagctacagctaccagcgatgatggtttgatcatggcattggcacatgaagtgcttccgcagtggggtgtgcaatttcatccggaatctattggtggacaattcggccatcagatcattaagaacttccttaatttagcgcgcacatatcgctggcaactcacggagaaaactattccgctcagcgttgattcagcagcggtttttgaaacattctttgcccattcctcccatgctttttggctcgatgatgcccaaggaaccagctatcttggtgatgccagcggtcctctcgcacgcacaaaaacccataatgtcggcgagggggatttcttcacctggctaaaggaggatctcgccgccaactcagttgcgcccggtcaaggttttcgtcttggctgggttggttacgttggttatgagcttaaagcggaagctggcgcacgggctgcgcacacttcgagtcttccggatgcgcacctcatttttgccgatcgcgccatcgcagtggaatcggatcaggttcggttgctggcgttgggggagcaggacgagtggtttgaagaaaccatcaagaagctgcataatcttgtcgccccgcggatacctgcgtccggacacctcgctttgcaggttcgagattccaaagatgagtatctcgacaaaattcgcagagcccaggagctgattactcgcggcgaatcgtatgaaatctgcctgaccacaaaacttcagggcaccactgatgtggcccctctggctgcctatctagcactgcgtggggccaatcccaccgcatatggtgcgtatcttcagctgggggatacctctattttgagttcctcgccggagcggttcatcaccattgattcggcagggtatgtggaatcaaagcccattaaaggcaccaggccgcgtgggcgaacagcgcaagaagaccaagaaatcattgctgagctgcgcagtaatcctaaagatcgtgcagaaaacttgatgatcgtggatttggtccgcaacgacttagcccgcggcgctttgcccaccacagttaaaacatccaagcttttcgacgtcgaaacctacgccacagtccaccaacttgtcagcaccgtctctgcagagttggggccacgcagtccgattgagtgcgtgcgcgcagcattccccggtggttcgatgactggtgccccaaagctgcgcaccatggagatcatcgatgagctggaggcagctcctcgcggtatttactcaggtggcttgggatatttttccctcgacggcgcagttgatctctccatggtgatcagaactctcgtcatccagaacaatcacgtggagtacggagtgggcggtgcacttcttgctctgtctgatccggaggctgagtgggaggaaatccgcgttaaatcacggcctctgctgaatttgtttggggttgaattcccatgacgtacctcgtgtgggacggt

SEQ ID NO: 460 - protein, 620 aa, Corynebacterium glutamicum
MRVLIIDNYDSFTFNLATYVEEVTGQAPVVVPNDQEIDEMLFDAVILSPGPGHAGVAADFGICAGVIERARVPILGVCLGHQGIALAYGGDVDLAPRPVHGEVSQITHDGSGLFAGIPETFEAVRYHSMVATRLPESLKATATSDDGLIMALAHEVLPQWGVQFHPESIGGQFGHQIIKNFLNLARTYRWQLTEKTIPLSVDSAAVFETFFAHSSHAFWLDDAQGTSYLGDASGPLARTKTHNVGEGDFFTWLKEDLAANSVAPGQGFRLGWVGYVGYELKAEAGARAAHTSSLPDAHLIFADRAIAVESDQVRLLALGEQDEWFEETIKKLHNLVAPRIPASGHLALQVRDSKDEYLDKIRRAQELITRGESYEICLTTKLQGTTDVAPLAAYLALRGANPTAYGAYLQLGDTSILSSSPERFITIDSAGYVESKPIKGTRPRGRTAQEDQEIIAELRSNPKDRAENLMIVDLVRNDLARGALPTTVKTSKLFDVETYATVHQLVSTVSAELGPRSPIECVRAAFPGGSMTGAPKLRTMEIIDELEAAPRGIYSGGLGYFSLDGAVDLSMVIRTLVIQNNHVEYGVGGALLALSDPEAEWEEIRVKSRPLLNLFGVEFP

SEQ ID NO: 461 - DNA, 747 bp, Corynebacterium glutamicum
  CDS (101)..(724): RXA00958
attctaatcctcaatctgaagccgatgagacgttgcacaaggcgtatgccgtgttgaatgccattgcgcttgctgctggttccactttggaggtcatccgatgacacacgttgttctcattgataatcacgattcttttgtctacaacctggtggatgcgttcgccgtggccggttataagtgcacggtgttccgcaatacggtgccagtggaaaccattttggcagccaacccggacctgatctgcctttcacctggacctggttaccctgccgatgcgggcaacatgatggcgctgatcgagcgcacactcggccagattcctttactgggtatttgcctcggctaccaggcactcatcgaataccacggcggcaaggttgagccttgtggccctgtgcacggcaccaccgacaacatgatccttactgatgcaggtgtgcagagccctgtttttgcaggtcttgccactgatgttgagcctgatcatccagaaatcccaggccgcaaggttccaattggccgttatcactcactgggctgcgtggttgccccagacggtattgaatcactaggtacctgttcctcggagattggtgatgtcatcatggcggcacgcaccaccgatggaaaggccattggcctgcagtttcaccctgagtcagtgctaagcccaacgggtcctgtcattttgtcccgctgtgtcgaacagcttctcgcgaactaataaaaaaaggatttgattca

SEQ ID NO: 462 - protein, 208 aa, Corynebacterium glutamicum
MTHVVLIDNHDSFVYNLVDAFAVAGYKCTVFRNTVPVETILAANPDLICLSPGPGYPADAGNMMALIERTLGQIPLLGICLGYQALIEYHGGKVEPCGPVHGTTDNMILTDAGVQSPVFAGLATDVEPDHPEIPGRKVPIGRYHSLGCVVAPDGIESLGTCSSEIGDVIMAARTTDGKAIGLQFHPESVLSPTGPVILSRCVEQLLAN

SEQ ID NO: 463 - DNA, 469 bp, Corynebacterium glutamicum
  CDS (101)..(469): RXN03007
cagtttcaccctgagtcagtgctaagcccaacgggtcctgtcattttgtcccgctgtgtcgaacagcttctcgcgaactaataaaaaaaggatttgattcatgacttctccagcaacactgaaagttctcaacgcctacttggataaccccactccaaccctggaggaggcaattgaggtgttcaccccgctgaccgtgggtgaatacgatgacgtgcacatcgcagcgctgcttgccaccatccgtactcgcggtgagcagttcgctgatattgccggcgctgccaaggcgttcctcgcggcggctcgtccgttcccgattactggcgcaggtttgctagattccgctggtactggtggcgacggtgccaacaccatcaacatcaccaccggcgcatccctgatcgcagcatccggtggagtgaagctggttaagcacggcaaccgttcggtgagctccaagtccggc

SEQ ID NO: 464 - protein, 123 aa, Corynebacterium glutamicum
MTSPATLKVLNAYLDNPTPTLEEAIEVFTPLTVGEYDDVHIAALLATIRTRGEQFADIAGAAKAFLAAARPFPITGAGLLDSAGTGGDGANTINITTGASLIAASGGVKLVKHGNRSVSSKSG

SEQ ID NO: 465 - DNA, 564 bp, Corynebacterium glutamicum
  CDS (101)..(541): RXN02918
agattgtcgcttttcccatttctccgggttttctggaactttttgggcgtatgctgggaatgattctattattgccaaatcagaaagcaggagagacccgatgagcgaaatcctagaaacctattgggcaccccactttggaaaaaccgaagaagccacagcactcgtttcatacctggcacaagcttccggcgatcccattgaggttcacaccctgttcggggatttaggtttagacggactctctggaaactacaccgacactgagattgacggctacggcgacgcattcctgctggttgcagcgctatccgtgttgatggctgaaaacaaagcaacaggtggcgtgaatctgggtgagcttgggggagctgataaatcgatccggctgcatgttgaatccaaggagaacacccaaatcaacaccgcattgaagtattttgcgctctccccagaagaccacgcagcagcagatcgcttcgatgaggatgacctgtctgagcttgccaacttgagtgaagagctgcgcggacagctggactaattgtctcccatttaaggagt

SEQ ID NO: 466 - protein, 147 aa, Corynebacterium glutamicum
MSEILETYWAPHFGKTEEATALVSYLAQASGDPIEVHTLFGDLGLDGLSGNYTDTEIDGYGDAFLLVAALSVLMAENKATGGVNLGELGGADKSIRLHVESKENTQINTALKYFALSPEDHAAADRFDEDDLSELANLSEELRGQLD

SEQ ID NO: 467 - DNA, 735 bp, Corynebacterium glutamicum
  CDS (101)..(712): RXN01116
tgccaggaatttacgtcaaccgcgtcgtccacgttggaccgcaggaaaccggaatcgaaaacaggacggtgtctaactaatgacttgggatcataaccaaatggcagcccgcgttgcccaggaacttgaagacggccagtacgtcaacctcggcatcggcatgcctacacttatccccggctacctgcctgagggactagaggttatccttcactccgaaaacggtgtgctgggcgttggaccttacccaactgaagaggaacttgatcctgagctgatcaacgccggcaaggaaaccatcacggttgcacctggcgcatcctacttctcctcttctgattctttcgccatgatccgctccaagtctgtcgacgttgcagtcttgggcgttatggaagtctcccagtacggcgacctggccaactggatgattcccggcaagctggtcaagggtatgggtggcgcaatggatctggtgcacggcgcatccaagatcatcgccatgaccgatcacatcaccaagaagggcgctccgaagatccttaaggagtgtcgcctcccactgactggcgcgaagtgcgtggacatgattgtcaccacccacgctgtgttctctgtggaccctgaagaaggcctcacgctcatcgagtgcgccgacggtgtcaccgttgaggaactccgcgaaatcaccgaagccgatttcaaagttgcttaagcaaacgctgcgcaattaag

SEQ ID NO: 468 - protein, 204 aa, Corynebacterium glutamicum
MAARVAQELEDGQYVNLGIGMPTLIPGYLPEGLEVILHSENGVLGVGPYPTEEELDPELINAGKETITVAPGASYFSSSDSFAMIRSKSVDVAVLGVMEVSQYGDLANWMIPGKLVKGMGGAMDLVHGASKIIAMTDHITKKGAPKILKECRLPLTGAKCVDMIVTTHAVFSVDPEEGLTLIECADGVTVEELREITEADFKVA

SEQ ID NO: 469 - DNA, 876 bp, Corynebacterium glutamicum
  CDS (101)..(853): RXN01115
ctcaccgcatgcagcgtgaaaacactcagtacggactggccaccatgtgcatcggtggcggccagggtcttgcagctgtctttgaaaaggagaactaaaaatggctattttgcacagcgtttcctacggaacttccgacaacaccttggtgttcattggctcgttgggttccaccaccgacatgtggctgccacagctggatgccttgcataaggatttccgcgtcatcgctgttgatcaccgcggacatggtctgtctgaactcatcgaaggcacccccactgtggcggatctggcgcaggatgtgctggataccctcgatgacctgggtgtcggaaacttcggcgtcatcggactatctctcggcggagcggttgcacaatacttggcggccacctctgatcgtgtcaccaaggcagcattcatgtgtaccgctgcaaaattcggcgagccccagggctggctagatcgcgccgcagcgtgccgcgaaaacggcactggttctctgtccgaagctgtgatccagcgctggttctcccccacttggttggagaacaacccagcgtcccgcgagcacttcgaagccatggttgccggcaccccatctgagggttacgcgctgtgctgcgaggcgttggcaacctgggatttcaccgatcgcctgggagaaatcaccgtgccagtgctcaccatcgcaggtgccgatgacccctccactcctccagcaaccgtgcagatcattgccgatggcgttggcggcgagtcccgcgcagaggtcctaagcccagccgcgcacgtaccaaccgtggaacgtccaaacgaggtaaatgaactgctagcacagcatttcgcttaatgttgtaggcatgttcacaa

SEQ ID NO: 470 - protein, 251 aa, Corynebacterium glutamicum
MAILHSVSYGTSDNTLVFIGSLGSTTDMWLPQLDALHKDFRVIAVDHRGHGLSELIEGTPTVADLAQDVLDTLDDLGVGNFGVIGLSLGGAVAQYLAATSDRVTKAAFMCTAAKFGEPQGWLDRAAACRENGTGSLSEAVIQRWFSPTWLENNPASREHFEAMVAGTPSEGYALCCEALATWDFTDRLGEITVPVLTIAGADDPSTPPATVQIIADGVGGESRAEVLSPAAHVPTVERPNEVNELLAQHFA

SEQ ID NO: 471 - DNA, 1284 bp, Corynebacterium glutamicum; identical to SEQ ID NO: 111
  CDS (101)..(1261): RXS00116

SEQ ID NO: 472 - protein, 387 aa, Corynebacterium glutamicum; identical to SEQ ID NO: 112

SEQ ID NO: 473 - DNA, 607 bp, Corynebacterium glutamicum; identical to SEQ ID NO: 113
  CDS (101)..(607): FRXA00116

SEQ ID NO: 474 - protein, 169 aa, Corynebacterium glutamicum; identical to SEQ ID NO: 114

SEQ ID NO: 475 - DNA, 843 bp, Corynebacterium glutamicum
  CDS (101)..(820): RXS00391
atcttgtagatcccaccgcaattctgggagatctcgaggacgcaatctctggaagaaaactttcctccccatccctgtacaagataaaacccgtgcacagttgctgcgcgattctcaacgagttggcctcgccatcgatccttcgatcgctttggtgatggccacttctggttctacaggtaccccgaagggcgctcagctcactccgttgaatttggtgagttccgccgatgctacgcatcagtttttaggtggcgaaggccagtggttgcttgccatgccagcacaccacattgcaggcatgcaggtgcttcttcgaagcctcattgctggagttgagccactagctattgatctcagcacaggttttcacattgacgctttcgcaggcgccgcggcagaactgaaaaataccggcgaccgcgtctatacatccttgactccaatgcagttacttaaagcaatggactccttgcaaggcattgaagccctgaaactttttgatgtcattcttgttggcggtgctgcattgtctaagcaggcccgaatttctgcggagcagctagacatcaacattgtcaccacctacggctcctcagagacttcaggtggctgcgtttatgatggcaagcccattcccggcgcgaaagtccgtatttcggatgagcgcattgagttgggtggcccgatgattgcgcagggctacagaaatgcacctgaacatccggatttcgccaacgagggttggtttaccacctctgattcaggtgaactccacgacgggattctcaccgtgactggtcgcgtggatacccgtcattgattccggtggattgaagttgc

SEQ ID NO: 476 - protein, 240 aa, Corynebacterium glutamicum
LLRDSQRVGLAIDPSIALVMATSGSTGTPKGAQLTPLNLVSSADATHQFLGGEGQWLLAMPAHHIAGMQVLLRSLIAGVEPLAIDLSTGFHIDAFAGAAAELKNTGDRVYTSLTPMQLLKAMDSLQGIEALKLFDVILVGGAALSKQARISAEQLDINIVTTYGSSETSGGCVYDGKPIPGAKVRISDERIELGGPMIAQGYRNAPEHPDFANEGWFTTSDSGELHDGILTVTGRVDTRH

SEQ ID NO: 477 - DNA, 1017 bp, Corynebacterium glutamicum
  CDS (101)..(994): RXS00393
tctattcatttcacaatagcgtttcacactcccccatagcctgccgaacgtatttcaagcaattgcgcgatcgagtatgtgatggggaaagatagaggttatgtctcacacggaaccccagccgaattctgtaactttgtccgattggattcaaggcgcacgcccgcgtacctgggcaaatgcgttcgcgcctgtcattgccggttcaggtgtcgccgcttttcatgatggttttgtgtggtggaaggccttgctggcgcttgtcgtggcgtgggctttgatcatcggtgtgaattacgccaatgattactctgatggcattcgtggcaccgatgaagaccgcaccggtcctctgcgactcactggttctgggttggctgagccgaagaaagtgaaagctgcggcgtttatttctttcggtatcgcaggtgtcgccggcaccgcgctgagcctgttgagcgcgtggtggctgatcctcatcggcatcctgtgtgtgctgggcgcgtggttctacaccggcggtaaaaatccttatggttaccgcgggctcggcgagattgctgtgttcatcttcttcggcctcgtcgcggtcatgggaacgcagttcacccaaaccggttccgtcagctgggccggtttggccgccgcagttggcgtggggtcgatgtctgctggcgtgaacttggccaacaatattcgcgatattccaaccgatagcaagaccggaaaaattaccctcgcggtccgcctgggcgatgcgggtgctcgtaagctgttcctcgcgctgatttccacgccgttcatcatgtccatctgcctggcgtttgtcgcctggccagcgctgatcgcgatcatcgttttcccgctggcactgaaagccgcagggccgatccgcaacaacgccaccggcaaggatctcatccccgtcatcggctcaacagggcgcgccatggcgttgtgggccgtgctcacgggcctggcattagcgtttagctaaaacgcttttcgacgctcccc

SEQ ID NO: 478 - protein, 298 aa, Corynebacterium glutamicum
MSHTEPQPNSVTLSDWIQGARPRTWANAFAPVIAGSGVAAFHDGFVWWKALLALVVAWALIIGVNYANDYSDGIRGTDEDRTGPLRLTGSGLAEPKKVKAAAFISFGIAGVAGTALSLLSAWWLILIGILCVLGAWFYTGGKNPYGYRGLGEIAVFIFFGLVAVMGTQFTQTGSVSWAGLAAAVGVGSMSAGVNLANNIRDIPTDSKTGKITLAVRLGDAGARKLFLALISTPFIMSICLAFVAWPALIAIIVFPLALKAAGPIRNNATGKDLIPVIGSTGRAMALWAVLTGLALAFS

SEQ ID NO: 479 - DNA, 1005 bp, Corynebacterium glutamicum
  CDS (101)..(982): FRXA00393
tctattcatttcacaatagcgtttcacactcccccatagcctgccgaacgtatttcaagcaattgcgcgatcgagtatgtgatggggaaagatagaggttatgtctcacacggaaccccagccgaattctgtaactttgtccgattggattcaaggcgcacgcccgcgtacctgggcaaatgcgttcgcgcctgtcattgccggttcaggtgtcgccgcttttcatgatggttttgtgtggtggaaggccttgctggcgcttgtcgtggcgtgggctttgatcatcggtgtgaattacgccaatgattactctgatggcattcgtggcaccgatgaagaccgcaccggtcctctgcgactcactggttctgggttggctgagccgaagaaagtgaaagctgcggcgtttatttctttcggtatcgcaggtgtcgccggcaccgcgctgagcctgttgagcgcgtggtggctgatcctcatcggcatcctgtgtgtgctgggcgcgtggttctacaccggcggtaaaaatccttatggttaccgcgggctcggcgagattgctgtgttcatcttcttcggcctcgtcgcggtcatgggaacgcagttcacccaaaccggttccgtcagctgggccggtttggccgccgcagttggcgtggggtcgatgtctgctggcgtgaacttggccaacaatattcgcgatattccaaccgatagcaagaccggaaaaattaccctcgcggtccgcctgggcgatgcgggtgctcgtaagctgttcctcgcgctgatttccacgccgttcatcatgtccatctgcctggcgtttgtcgcctggccagcgctgatcgcgatcatcgttttcccgctggcactgaaagccgcagggccgatccgcaacaacgccaccggcaaggatctcatcccgtcatcggctcaacagggcgcgccatggcgttgtgggccgtgctcacgggcctggcattagcgtttagctaaaacgctttt

SEQ ID NO: 480 - protein, 294 aa, Corynebacterium glutamicum
MSHTEPQPNSVTLSDWIQGARPRTWANAFAPVIAGSGVAAFHDGFVWWKALLALVVAWALIIGVNYANDYSDGIRGTDEDRTGPLRLTGSGLAEPKKVKAAAFISFGIAGVAGTALSLLSAWWLILIGILCVLGAWFYTGGKNPYGYRGLGEIAVFIFFGLVAVMGTQFTQTGSVSWAGLAAAVGVGSMSAGVNLANNIRDIPTDSKTGKITLAVRLGDAGARKLFLALISTPFIMSICLAFVAWPALIAIIVFPLALKAAGPIRNNATGKDLIPSSAQQGAPWRCGPCSRAWH

SEQ ID NO: 481 - DNA, 987 bp, Corynebacterium glutamicum; identical to SEQ ID NO: 395
  CDS (101)..(964): RXS00446

SEQ ID NO: 482 - protein, 288 aa, Corynebacterium glutamicum; identical to SEQ ID NO: 396

SEQ ID NO: 483 - DNA, 545 bp, Corynebacterium glutamicum; identical to SEQ ID NO: 397
  CDS (1)..(522): FRXA00446

SEQ ID NO: 484 - protein, 174 aa, Corynebacterium glutamicum; identical to SEQ ID NO: 398

SEQ ID NO: 485 - DNA, 1230 bp, Corynebacterium glutamicum; identical to SEQ ID NO: 115
  CDS (101)..(1207): RXS00618

SEQ ID NO: 486 - protein, 369 aa, Corynebacterium glutamicum; identical to SEQ ID NO: 116

SEQ ID NO: 487 - DNA, 657 bp, Corynebacterium glutamicum; identical to SEQ ID NO: 117
  CDS (101)..(634): FRXA00618

SEQ ID NO: 488 - protein, 178 aa, Corynebacterium glutamicum; identical to SEQ ID NO: 118

SEQ ID NO: 489 - DNA, 385 bp, Corynebacterium glutamicum; identical to SEQ ID NO: 119
  CDS (101)..(385): FRXA00627

SEQ ID NO: 490 - protein, 95 aa, Corynebacterium glutamicum; identical to SEQ ID NO: 120

SEQ ID NO: 491 - DNA, 1221 bp, Corynebacterium glutamicum; identical to SEQ ID NO: 399
  CDS (101)..(1198): RXS01105

SEQ ID NO: 492 - protein, 366 aa, Corynebacterium glutamicum; identical to SEQ ID NO: 400

SEQ ID NO: 493 - DNA, 1752 bp, Corynebacterium glutamicum
  CDS (101)..(1729): RXS02315
cgtttggaaacgcttgctgccagcaaagataggcgtgattggtggtttgagcgcgtgcgtgaatcgtatccgtacctggagacgatctagactgttgtgcatgtccagcacgccagctcaagatcttgcccgcgccgttattgattccctcgcaccacacgtcactgacgtggtgttatgcccaggatccaggaactcaccgttgtcgcttgagttgctggcgcggcaggatctgcgtgtccatgtgcgtatcgacgagcgcagcgcctcatttttggcgctgtccctagcgcgtacccaggcccggccggtggctgtggtgatgacctccggcacggctgtagctaactgcctgcctgctgttgctgaagctgcgcatgcccatatcccgttgattgtgctctctgctgaccgtcctgcacatttggtgggaacgggggcgagccaaacgattaaccagaccggtatttttggtgatcttgcaccgacggtcggtatcactgagctggatcaggtagcgcagattgctgaaagccttgctcagggggcttcccagattccgcgtcatttcaatcttgcacttgatgttcctttggttgctcctgaactgccagagcttcatggtgaggcagttggagcatcatggacgcatcgctggatcaaccacggtgaggtgaccgtggacctgggggagcacaccctcgtgattgccggtgatgaagcatgggaagtggaagggctggaagatgtgcccaccatcgctgaacctactgcaccaaagccttataatccggtgcacccactggctgctgaaatcttgctgaaggagcaggtctccgcggaaggctatgtggtaaacaccaggcctgatcatgtgatcgtggtgggacaccccacgctgcaccgcggagtgttgaagttgatgtcagatcctggcattaaattaactgtgctttcacgcaccgatatcatcactgatcccggccgccatgccgatcaggtgggcagcacagtgaaagtcaccggcacccaggaaaagcagtggctaaagatctgttcggcagcatcagaacttgcggccgatggtgtgcgtgacgtcctggacaaccaagaattcggtttcaccggcctccatgttgccgcagccgtggcggataccttaggcaccggcgatactctctttgctgcagcatccaactcaatccgtgacctctccctggtgggtatgccttttgatggcgtggataccttctccccacgaggtgtcgcaggcattgatggttctgttgctcaagcaatcggcacttcacttgctgtgcagtcccgccaccccgatgaaatccgcgcgccacgcactgtggcccttctgggcgatctgtcgttccttcacgatattggcggactgctcatcggccctgatgaaccacgcccagaaaacctcaccatcgtggtctccaacgacaacggtggcggaatcttcgaactcctagaaaccggcgcagatggtctccgccccaacttcgagcgtgctttcggtaccccacacgacgcgtccatcgcggatctctgcgcaggctacggcattgaacaccaagtggtagacaacctccaagacctcatcatcgcgctagttgataccaccgaagtatccggattcaccattattgaagcttcgaccgtccgagatacccgccgtgcacaacagcaagctctcatggacacggtgcactaaatggagtggtaccaagtgcg

SEQ ID NO: 494 - protein, 543 aa, Corynebacterium glutamicum
MSSTPAQDLARAVIDSLAPHVTDVVLCPGSRNSPLSLELLARQDLRVHVRIDERSASFLALSLARTQARPVAVVMTSGTAVANCLPAVAEAAHAHIPLIVLSADRPAHLVGTGASQTINQTGIFGDLAPTVGITELDQVAQIAESLAQGASQIPRHFNLALDVPLVAPELPELHGEAVGASWTHRWINHGEVTVDLGEHTLVIAGDEAWEVEGLEDVPTIAEPTAPKPYNPVHPLAAEILLKEQVSAEGYVVNTRPDHVIVVGHPTLHRGVLKLMSDPGIKLTVLSRTDIITDPGRHADQVGSTVKVTGTQEKQWLKICSAASELAADGVRDVLDNQEFGFTGLHVAAAVADTLGTGDTLFAAASNSIRDLSLVGMPFDGVDTFSPRGVAGIDGSVAQAIGTSLAVQSRHPDEIRAPRTVALLGDLSFLHDIGGLLIGPDEPRPENLTIVVSNDNGGGIFELLETGADGLRPNFERAFGTPHDASIADLCAGYGIEHQVVDNLQDLIIALVDTTEVSGFTIIEASTVRDTRRAQQQALMDTVH

SEQ ID NO: 495 - DNA, 1434 bp, Corynebacterium glutamicum; identical to SEQ ID NO: 121
  CDS (101)..(1411): RXS02550

SEQ ID NO: 496 - protein, 437 aa, Corynebacterium glutamicum; identical to SEQ ID NO: 122

SEQ ID NO: 497 - DNA, 1080 bp, Corynebacterium glutamicum
  CDS (101)..(1057): RXS02319
atgtgggtgagataaccgaccgtgatgtcgccctagcaaaagtcatcgacgcccacgccaagaccttggccatttcggcagaggcttaaggttaaagattatgagcaactacagcaccgacaacccttttgatcccacccaatgggccaccgttccaggttttgaagaattcaccgacatcacctaccaccgccacgtgggcaccacccgcgccgatggcatcgtgcgcatcgccttcgaccgccccgaagttcgcaatgctttccgcccccacaccgtcgacgagctttaccaagccctcgaccacgcgcgccggaccccagatgttggaaccatcctgctcaccggcaacggccccagcgaaaaagacggtggctgggcgttctgctccggcggcgaccaacgcatccgcgggcgctccggctaccaatacgccaccgaacacgcgcgcgacgatgccaccgctgatgtcttcacggtagatattgcccgcaccaaagttgaaggcggacgcctccacattttggaagtccaacgcctcatccgcaccatgcctaaagttgtcatcgcagtagtcaacggctgggcagccggcggtgggcactccctccatgtcgtttgcgacctcaccatcgcttcccgccaagaagcacgcttcaagcaaaccgacgctgacgtgggatccttcgacgctggctacggctccgcctacctagcgaaaatggtcggacagaaaaacgcccgcgaaatcttcttcctcggacgcacctacgacgccgaacgcatgcaacaaatgggcgcagtcaacatcgtggccgaccacggcgacctagaaaaagaagccatccaagcagcccgcgaaatcaacaccaaatcccccaccgggcaacgcatgctgaaattcgccttcaatctcaccgacgatggcctcatgggacaacaagtcttcgccggcgaagccacccgcctggcctacatgacggatgaagccgtagagggtaaggaagcattcctagaaaagcgcgaacccaactggaatgaattcccttactactactagtgagttcatggggtcctaaa

SEQ ID NO: 498 - protein, 319 aa, Corynebacterium glutamicum
MSNYSTDNPFDPTQWATVPGFEEFTDITYHRHVGTTRADGIVRIAFDRPEVRNAFRPHTVDELYQALDHARRTPDVGTILLTGNGPSEKDGGWAFCSGGDQRIRGRSGYQYATEHARDDATADVFTVDIARTKVEGGRLHILEVQRLIRTMPKVVIAVVNGWAAGGGHSLHVVCDLTIASRQEARFKQTDADVGSFDAGYGSAYLAKMVGQKNAREIFFLGRTYDAERMQQMGAVNIVADHGDLEKEAIQAAREINTKSPTGQRMLKFAFNLTDDGLMGQQVFAGEATRLAYMTDEAVEGKEAFLEKREPNWNEFPYYY

SEQ ID NO: 499 - DNA, 384 bp, Corynebacterium glutamicum
  CDS (101)..(361): RXS02908
gccaacgagggttggtttaccacctctgattcaggtgaactccacgacgggattctcaccgtgactggtcgcgtggatacccgtcattgattccggtggattgaagttgcacccagaggtactggaacgtgccatcgcagatattaaaggtgtcaccgcggcgtgtgttgtgggtattcccgatccccgattaggccaagcaattgtggccgcgtactccggatcgatcagtccgtctgaagttattgaaggcctcgacgatctacctcgttggcagcttcccaaacggctgaagcatctggaatctttgcccagcattggtcctggaaaagctgatcgacgtgctatcgcgaagctgttttagtcttcattcttgctggctgc

SEQ ID NO: 500 - protein, 87 aa, Corynebacterium glutamicum
LKLHPEVLERAIADIKGVTAACVVGIPDPRLGQAIVAAYSGSISPSEVIEGLDDLPRWQLPKRLKHLESLPSIGPGKADRRAIAKLF

SEQ ID NO: 501 - DNA, 775 bp, Corynebacterium glutamicum; identical to SEQ ID NO: 127
  CDS (101)..(775): RXS03003

SEQ ID NO: 502 - protein, 225 aa, Corynebacterium glutamicum; identical to SEQ ID NO: 128

SEQ ID NO: 503 - DNA, 390 bp, Corynebacterium glutamicum
  CDS (101)..(367): RXS03026
gttggcggcgcagtatcgtgaggtgcgggacctcgagcggggaatcccaaactagcatcccgaactagccccccaacaacaattagaaatggaacctaaaatgcctggaaaaattctccttctcaacggcccaaacctgaacatgctgggcaaacgcgagcctgacatttacggacacgacaccttggaagacgtcgtcgcgctggcaaccgctgaggctgcgaaacacggccttgaggttgaggcgctgcagagcaatcaccaaggtgagctaatcgatgcgctgcacaacgctcgcgggacccacatcggttgcgtgattaaccccggcggcctgactacacttcggtggcgcttttggatgctgtgaaggcgtctgagcttcctacc

SEQ ID NO: 504 - protein, 89 aa, Corynebacterium glutamicum
MPGKILLLNGPNLNMLGKREPDIYGHDTLEDVVALATAEAAKHGLEVEALQSNHQGELIDALHNARGTHIGCVINPGGLTTLRWRFWML

SEQ ID NO: 505 - DNA, 621 bp, Corynebacterium glutamicum; identical to SEQ ID NO: 215
  CDS (101)..(598): RXS03074

SEQ ID NO: 506 - protein, 166 aa, Corynebacterium glutamicum; identical to SEQ ID NO: 216

SEQ ID NO: 507 - DNA, 3075 bp, Corynebacterium glutamicum
  CDS (101)..(3052): RXC01434
ggtttcctgcgcaccgtgatgattggtgcggcgctgtcgccggccatcgcttcggcgttcaacactgccaacacgctgcccaacctgatcactggaaatcgtgttgggtgcggtgctgacatcgctggttattccggtccttacccgcgcggaaaaagaagacgccgacggcggttccgggttcttcaggcggctgctcaccctgtcggtgacgctgctgggtggtgtcaccatcctgtcgattatcggcgcgccgctgctgacacggatgatgctgtcctctgagggacaagtcaacgtggtcatgtccacggcctttgcgtattggctgctgccacagattttcttctacggcctgtttgccctgttcatggctgtgttgaacacccgtgaagtgttcaaacccggcgcgtgggcacctgttgtcaacaatgtgatcaccttgaccgtgctgggcgtgtacatggtgctgcctgcgcgtttgcacccgcatgagcaggtgggcatttttgatccgcagatcattttcctcggcgtgggcaccacccttggtgtggttgcacagtgtctaatcatgattccgtacctgcgtcgcgcgggcattgatatgcgccctctgtggggtatcgatgcgcgtttgaagcaattcggtggcatggcgatggcgatcatcgtgtacgtggcaatctcccagttcggttacatcatcaccactcgcattgcgtcgattgcagacgatgctgcgccgtttatttatcagcagcactggatgttgctgcaagttccttatggcatcatcggcgtcaccttgctcaccgcgattatgccgcgactgtcccgcaacgcggcagacggcgatgatagggcagtagtctctgaccttcagttgggttccaagctaaccttcatcgcactgatccccatcgtggtgttcttcaccgccttcggtgtccctattgccaatggcctttttgcctacggccaattcgatgccaacgccgccaacatccttggttggactctgagcttctctgctttcacgctgattccttacgctttggtgctgctacatctgcgtgtgttttatgcgcgtgaagaggtctggaccccaaccttcatcatcgccggcatcaccgccaccaaggtcgtgctttccctgttggcaccgctgctgtcgagctccccggagcgtgtggtggtgcttcttggtgcggccaacggtttcagtttcatcaccggcgcggtcatcggcgcgtatctgttgcgcaacaaactcggcctgttgggtatgcgctctttggctaaaacctccctgtgggcgttgggctctgcggcggttggtgcagcagcagcatgggcgttggggtggctgattcaagccgtcgtgggcgatttcttgctgggcactctaagctccgtaggctacttgttgaacctggctgtgttgggtgtcttcttcatcttcgtcaccggcatcgtgttgtcacgttctggtttgccggaggtccaaaacttgggccaggcactgacccgcatcccaggtttgagccggtttattcgcccgaataccaagatctctttggatgtcggcgaagtctccgagcaggatttctccacccagctggtcgcgccaagcgagttcgcagcaacccctgtgccgccaccgatgtccgccggtattgtccgcggacctcgcctggttcccggcgccccagtcggcgacggtcgtttccgtctgctcgccgatcacggcggcgtccaaggcgcgcgtttctggcaggcccgcgagatcgccaccggcaaggaagtcgcgctgatctttgtggatacttccggcaacgccccatttgcgccactgtcttcggcagccgcagcgggcatcgcctacgaggtgcagcgccgcaccaagaagctggccagcttgggcagcttggcggtagcccccaacatccactccgaggcgtaccgcaacggttgcctcattgtggccgattgggtgcctggctccagcttgagcgccgtcgcggaatccggtgccgatccccgcgccgccgcgttcgcgctcgcggaactaactgaaaccatcggcgaggcccacgagatgggtatcccggccggcttggacaacaagtgccgaattcgtatcaacaccgacggccatgccgtcctcgccttgccggcgattttgcccgatgcctcagagctccgcgacgccaagtccctggcctcggccgccgagatgcttatcgacgcgaccctcgctcccagcgacgtcaaggcaatggtcactgaagcccaggggctagctacagaagacaatcccgattacgcatcacttgccatggcgatgcgcacctgcggactgttcaccgaggaaccaacccaccttgtggtgaagaaggaaaagacaccaaagcctgcgacacgtgatggtttcggtgcctccgactacaccgtcaagggcatggcagccatcgccgctgtggtgatcatcttggtttccctggtggccgccggtaccgcgttcctcaccagcttcttcggcagcagcaccaacgaacaatccccgttggcctctgttgaagccaccacctctgcaacaccagaacctgtggggccaccggtctacctggatctggatcaagcccgcacgtgggatgacggtgcaggaacagatgtcaccgacgtcaccgacggcaacacctccaccgcatggacctccaccggcggcgacggcctcctagttgacctgtccacgcctgcccgcctcgaccgcgtcatcttgaccaccggcaccggctccgacagcaacgtgacctcgaccgtgaagatctacgcattcaacgacgcctcaccacactccctgtcggaaggcatcgagatcggcaccgtggattattccggccgcagtctcagccacagcatccgcgattcctccaagcttccgggtcaggtggaatccgtggtgattctggtcgatgaggttcgttcctcacaaacctcagacaccaatccacagatgcagatcgctgaagtacaacttgttggttggtaaattacgcgtttgtgattgac

SEQ ID NO: 508 - protein, 984 aa, Corynebacterium glutamicum
VLGAVLTSLVIPVLTRAEKEDADGGSGFFRRLLTLSVTLLGGVTILSIIGAPLLTRMMLSSEGQVNVVMSTAFAYWLLPQIFFYGLFALFMAVLNTREVFKPGAWAPVVNNVITLTVLGVYMVLPARLHPHEQVGIFDPQIIFLGVGTTLGVVAQCLIMIPYLRRAGIDMRPLWGIDARLKQFGGMAMAIIVYVAISQFGYIITTRIASIADDAAPFIYQQHWMLLQVPYGIIGVTLLTAIMPRLSRNAADGDDRAVVSDLQLGSKLTFIALIPIVVFFTAFGVPIANGLFAYGQFDANAANILGWTLSFSAFTLIPYALVLLHLRVFYAREEVWTPTFIIAGITATKVVLSLLAPLLSSSPERVVVLLGAANGFSFITGAVIGAYLLRNKLGLLGMRSLAKTSLWALGSAAVGAAAAWALGWLIQAVVGDFLLGTLSSVGYLLNLAVLGVFFIFVTGIVLSRSGLPEVQNLGQALTRIPGLSRFIRPNTKISLDVGEVSEQDFSTQLVAPSEFAATPVPPPMSAGIVRGPRLVPGAPVGDGRFRLLADHGGVQGARFWQAREIATGKEVALIFVDTSGNAPFAPLSSAAAAGIAYEVQRRTKKLASLGSLAVAPNIHSEAYRNGCLIVADWVPGSSLSAVAESGADPRAAAFALAELTETIGEAHEMGIPAGLDNKCRIRINTDGHAVLALPAILPDASELRDAKSLASAAEMLIDATLAPSDVKAMVTEAQGLATEDNPDYASLAMAMRTCGLFTEEPTHLVVKKEKTPKPATRDGFGASDYTVKGMAAIAAVVIILVSLVAAGTAFLTSFFGSSTNEQSPLASVEATTSATPEPVGPPVYLDLDQARTWDDGAGTDVTDVTDGNTSTAWTSTGGDGLLVDLSTPARLDRVILTTGTGSDSNVTSTVKIYAFNDASPHSLSEGIEIGTVDYSGRSLSHSIRDSSKLPGQVESVVILVDEVRSSQTSDTNPQMQIAEVQLVGW

SEQ ID NO: 509 - DNA, 930 bp, Corynebacterium glutamicum
  CDS (101)..(907): RXC02080
cgtaaattcgaagcgagcttctaattctagcaagcttggtgatggagtatcctgccaaaatttgtcctgttgcttattgtgcaggaattcggaggcggacatgtcaatcgagtggttacaaattgttgaattaggagcgatctttggtgcaggtttcctcgcaggaagcatcaatgtaattgtcggagcaggaacattagtgtcgtttcctattctcgtgttcctgggccttccaccgttgactgccaccatcgccaacaccatcggcatcgttcctggaagtatttcgggtgtggttgcttatagacgtgaactacacgcccatgtaaaaaccatcagatttctgctgccagcatcaatcctcggagggatcaccggcgcctcgctcttgctgcatttctccgcagatgtttttacagcagtaattccctggctgattggattcggcacgctgttggttatcgcaggtccatcaattaagaagcatgttggcgctcatacttcaggtggcatctctgctgggtttaggcaattgcctttcccgagccgaaccaccttcatcgtctcagtatgtggtgccctgttgctgggcatgtatggagggtacttcagcgcagctcaaggcattcttctcatcgcattgcttggcatcacatcaacgctgcagatgcaggaactcaacgccatcaaaaacctcacagtggcggcagttaatctcatcgcagccagtgtttttataatcatctcccctgagttgatctcctggccgaccgttgccttaatcgcgcttggctcagctttaggtggatacatcggcggacggtacgcccgccgacttcgccccagtgtttttagagcatttgtggtcatcgtcggaatcaccacggtcatcgttatgacgatcggttaatgcagcagactagtaacccc

SEQ ID NO: 510 - protein, 269 aa, Corynebacterium glutamicum
MSIEWLQIVELGAIFGAGFLAGSINVIVGAGTLVSFPILVFLGLPPLTATIANTIGIVPGSISGVVAYRRELHAHVKTIRFLLPASILGGITGASLLLHFSADVFTAVIPWLIGFGTLLVIAGPSIKKHVGAHTSGGISAGFRQLPFPSRTTFIVSVCGALLLGMYGGYFSAAQGILLIALLGITSTLQMQELNAIKNLTVAAVNLIAASVFIIISPELISWPTVALIALGSALGGYIGGRYARRLRPSVFRAFVVIVGITTVIVMTIG

SEQ ID NO: 511 - DNA, 669 bp, Corynebacterium glutamicum
  CDS (101)..(646): RXC02789
ttcttccgtacggctatgcttaaaagctaaatttgtctttgtgccttgcaacacattaatttcttaacactaaacaatggaaaggtaagcgggtttttctatgaaggtttccgccgatacacccggtcacgatgatccaggcccaggccggcgccttggcttagatgtcggcaccgtgcgcatcggagtggcagcctctgaccgcgatgccaagcttgccatgcctgtggaaaccgttccgcgggaaactggattcaaagggccagacctggccgatattgatcggttggtcgccatcgttgaggaatacaacgccgtggaagtcattgttggtctacccacagatctgcagggaaatggctccgccagtgtgaagcatgcaaaggaaattgctttccgcgtccgtcggcgcctcaccaatgctggaaagaacattccggtacggcttggcgacgaacgcctcaccaccgtcgtggccacccaagccttgcgggcctcaggagtcagcgaaaaagcgggacgtaaagttattgatcaagctgccgcagtagaaatccttcaaacctggttggatgctcgcacccgagcccttgaaccacaatccacagacacccaagatttcgacgagaagggaaatttcccaggatgaaccaaatccgaaaccgccgg

SEQ ID NO: 512 - protein, 182 aa, Corynebacterium glutamicum
MKVSADTPGHDDPGPGRRLGLDVGTVRIGVAASDRDAKLAMPVETVPRETGFKGPDLADIDRLVAIVEEYNAVEVIVGLPTDLQGNGSASVKHAKEIAFRVRRRLTNAGKNIPVRLGDERLTTVVATQALRASGVSEKAGRKVIDQAAAVEILQTWLDARTRALEPQSTDTQDFDEKGNFPG

SEQ ID NO: 513 - DNA, 903 bp, Corynebacterium glutamicum
  CDS (101)..(880): RXC02295
ttcccatgctaatccgcgaaaatggcacttcaacagccatatactttaaacaacacaaatgatgcaagactgataccgggatgtgataggagcgcaccacatggggttggaattagcagctagcgggtggggcatcctcatcgcaggcgccgccgtagccggatggatcgacgcagtaatcggcggtggcggactcgtcctcatcccgctgatcctcgcggtcatgccgcaactcgcacctgtgacagcgctggcctccaacaaactggcagccgtcaccggcacggcatcggcggcattcaccctggtcaggcgcgtcaaacccgacaaaaaactgcttgcgctctacgttctggtggcagctgtgtgctccggtgcaggcgccctggctgcgagtctcattgacaaacaaatcatgcgaccgctgatcatcgtgttgatgctggtcgttggcctgatcgtggtgttcaaaccaaacttcggaaccggcgaaagcaaagccctgcccaccggatggaaacgctgggccgccatcgttgcagtcggactcatcgcagcctacgacggcatcttcggacccggaaccggcatgttcctcatcatggcgttcaccgcactgctctcccaaaatttcctgtcctccgcagccatggcgaaggtcgtaaacaccgcaacaaacctgggtgcgctaattgtattcatcatcggcggccacatgtggtggaccctaggactcgtgctggcagtcgccaatgtcgcaggcgcacaactcggtgcccgaacggtgcttggtggcggtaccaggctaattagatacgcactactaaccctggttgtcgtcatgagcgtctacctcacctggcaacaaatccaaggaatgtagataagtcggggcaaactcta

SEQ ID NO: 514 - protein, 260 aa, Corynebacterium glutamicum
MGLELAASGWGILIAGAAVAGWIDAVIGGGGLVLIPLILAVMPQLAPVTALASNKLAAVTGTASAAFTLVRRVKPDKKLLALYVLVAAVCSGAGALAASLIDKQIMRPLIIVLMLVVGLIVVFKPNFGTGESKALPTGWKRWAAIVAVGLIAAYDGIFGPGTGMFLIMAFTALLSQNFLSSAAMAKVVNTATNLGALIVFIIGGHMWWTLGLVLAVANVAGAQLGARTVLGGGTRLIRYALLTLVVVMSVYLTWQQIQGM

SEQ ID NO: 515 - DNA, 1132 bp, Corynebacterium glutamicum
  CDS (101)..(1132): RXN03063
tgtctacaacttcgccctcatggacatattaacttcgttgcctcggagagaatactcatcacctagacaacagtttgtatctcacctcacaggaggaaccgtggaagatctctcataccgcatcccgcagtcgcgcaccgtggccgagcaggtgccagggccgaagtcgaaagcgctggatgagcgtcgacaagcagcagtagcacgagcacttgcaccgggtctgcctggatacgtggtggacgcagacggtggcatcttggctgacgcggacggcaaccgtttcatcgacctggcctccggcatcgccgtgaccacggtcggcggatccaacgcggccgtcgcgaaagccgtcggcgccgcagctgcccgcttcacccacacctgcttcatggtctcaccttatgaaacttacgtggccatggcggagagactcaacgccttgactccaggcgatcacgacaagaagagcgcgctgtttaactctggcgccgaagccgtggaaaacgccgtcaaggtggcacgcgcctacaccggcaagggcgcggtcgtggtgttcgacaacgcgtaccacggacggaccaacctcaccatggcgatgaccgcgaagaaccgcccatacaagtccggattcggaccactagccgcagacgtctaccgtgcaccaatgtcttacccactgcgcgacggactgtccggcccggaagccgcagagcgcgcgatctccgtgatcgaatcccaggtcggagccgaaaacctcgcctgcgtggtcattgaaccgatccagggcgaaggcggattcatcgtccccgcaccaggattcctcgcagccatttccacctggtgccgcgagaacgacgtggtgttcatcgccgatgaaatccaatctggcttcctgcgcaccggcgactggttcgccagcgacgcagaaggtgtgatccccgacgtcatcaccaccgcaaaaggcatcgccggcggcatgccactatccgcagtgaccggccgcgcagaaatcatggacgcacccggccccggcgcgctcggcggaacctacggcggaaaccccgttgcttgcgccgcggcacttgcagccattgaagtgatggaacaagccgaccttaagacccgcgcg

SEQ ID NO: 516 - protein, 344 aa, Corynebacterium glutamicum
VEDLSYRIPQSRTVAEQVPGPKSKALDERRQAAVARALAPGLPGYVVDADGGILADADGNRFIDLASGIAVTTVGGSNAAVAKAVGAAAARFTHTCFMVSPYETYVAMAERLNALTPGDHDKKSALFNSGAEAVENAVKVARAYTGKGAVVVFDNAYHGRTNLTMAMTAKNRPYKSGFGPLAADVYRAPMSYPLRDGLSGPEAAERAISVIESQVGAENLACVVIEPIQGEGGFIVPAPGFLAAISTWCRENDVVFIADEIQSGFLRTGDWFASDAEGVIPDVITTAKGIAGGMPLSAVTGRAEIMDAPGPGALGGTYGGNPVACAAALAAIEVMEQADLKTRA

SEQ ID NO: 517 - DNA, 1491 bp, Corynebacterium glutamicum; identical to SEQ ID NO: 3
  CDS (101)..(1468): RXN02970

SEQ ID NO: 518 - protein, 456 aa, Corynebacterium glutamicum; identical to SEQ ID NO: 4

SEQ ID NO: 519 - DNA, 1330 bp, Corynebacterium glutamicum; identical to SEQ ID NO: 5
  CDS (101)..(1330): FRXA01009

SEQ ID NO: 520 - protein, 410 aa, Corynebacterium glutamicum; identical to SEQ ID NO: 6

SEQ ID NO: 521 - DNA, 1998 bp, Corynebacterium glutamicum
  CDS (101)..(1975): RXA01551
cactacgtaggcgtaccccaccatcaccgcgtcgaaaagcgccctctcttaacccccgcaagggggtaacttttacgcgcacgcgtgcaacgcgctagttttgaaggcagtccccacgggcgcccgagcacgggctgagatcgcgctgattgctgcgcgagcaccgtttgaacctgtccggttagcaccggcgaaggaagagaggaatggtgcaatgacgcctacccaaaatgagatccacccgaaacatagctactcccccatccgcaaggacggtctcgaggtcccggagaccgaaatccgcctcgatgactcgccaagcggccccaacgaacccttccgcatctaccgcacccgtggcccagaaaccaaccccaagcagggacttccgcggctgcgcgagtcatggatcaccgcccgcggcgacgttgccacctatcaggggcgcgagcgtttgcttatcgacgacggccgctcggcaatgcgtcgaggtcaagcttcggctgagtggaaaggccaaaaaccagctcctttgaaggcgctacctggcaaaagagtcacccaaatggcctatgcacgtgctggcgtgattactcgtgaaatggagtttgtagcgctgcgcgaacacgttgatgcggagtttgtgcgctctgaggtggcgcgcggtcgggccattattcccaacaacgtcaaccaccccgaatctgaaccgatgattattggtcgcaaatttttgaccaaaatcaacgccaatattggcaattctgcggtcacctcttcaatcgaggaagaggtgtccaagctgcagtgggccacgcgctggggtgccgataccgtgatggatctatccaccggcgatgatattcacaccacccgcgaatggattatccgcaactcccccgttcctatcggcaccgtcccgatctaccaagcgctggaaaaagtaaatggcgtggccgcagaccttaactgggaagtattccgcgataccatcattgagcagtgtgaacaaggcgtggactatatgaccatccacgccggcgtcctgctggcttatatcccactgactacccgtcgtgtcaccggcattgtctcccgcggcggatccattatggccggttggtgtctggcgcatcaccgcgaatcattcctctacgagcatttcgacgagctgtgcgaaatctttgcacaatatgacgtcgcattctccctcggtgatggcctacgccccggatcgcttgccgatgccaacgacgccgcgcaattcgccgagctgaaaaccattggtgagctcacccaacgcgcctgggaatacgatgtacaagtaatggtcgaaggacctggacacgtgccactaaacatgatccaggaaaacaacgagctggaacaaaagtgggcagcggacgcacctttttacactcttggaccactagttaccgacatcgctccaggttatgaccacatcacttctgccattggtgcagctcacatcgccatgggtggcaccgccatgctgtgttatgtcaccccgaaagaacaccttggcctgcccaaccgtgacgacgtcaaaaccggcgtaatcacctacaagctcgctgcccacgcagcagatgtggccaagggtcatcccggcgcgcgtgcctgggacgacgccatgagtaaagcgcgttttgaattccgttggaatgatcagtttgcgctctccctcgaccccgacactgcaatcgcttatcacgacgaaaccctgccggcagagcctgcgaaaaccgcacacttctgttcaatgtgtggcccgaagttctgctccatgcgaattagccaggacattcgcgatatgtttggcgatcaaatcgcggaattggggatgcctggggttggggattcttctagtgctgttgcttctagtggggcacgggaggggatggctgagaaatcccgggaatttattgctggtggtgcggaggtttatcggcgttagacagagcgatcccagatagc

SEQ ID NO: 522 - protein, 625 aa, Corynebacterium glutamicum
LKAVPTGARARAEIALIAARAPFEPVRLAPAKEERNGAMTPTQNEIHPKHSYSPIRKDGLEVPETEIRLDDSPSGPNEPFRIYRTRGPETNPKQGLPRLRESWITARGDVATYQGRERLLIDDGRSAMRRGQASAEWKGQKPAPLKALPGKRVTQMAYARAGVITREMEFVALREHVDAEFVRSEVARGRAIIPNNVNHPESEPMIIGRKFLTKINANIGNSAVTSSIEEEVSKLQWATRWGADTVMDLSTGDDIHTTREWIIRNSPVPIGTVPIYQALEKVNGVAADLNWEVFRDTIIEQCEQGVDYMTIHAGVLLAYIPLTTRRVTGIVSRGGSIMAGWCLAHHRESFLYEHFDELCEIFAQYDVAFSLGDGLRPGSLADANDAAQFAELKTIGELTQRAWEYDVQVMVEGPGHVPLNMIQENNELEQKWAADAPFYTLGPLVTDIAPGYDHITSAIGAAHIAMGGTAMLCYVTPKEHLGLPNRDDVKTGVITYKLAAHAADVAKGHPGARAWDDAMSKARFEFRWNDQFALSLDPDTAIAYHDETLPAEPAKTAHFCSMCGPKFCSMRISQDIRDMFGDQIAELGMPGVGDSSSAVASSGAREGMAEKSREFIAGGAEVYRR

SEQ ID NO: 523 - DNA, 1013 bp, Corynebacterium glutamicum
  CDS (1)..(990): RXA01019
actttggcgcactcactttcattcccggattcgcttcgcgacgggccaaccgttggagacctcggggaatttgaagtgattcgggtaatcacggagcaagctggatcatctctcaacggcgatgacgcagctgtgcttcggcatgcatcacccaattccagggctgttgtcaccaccgacatgttggttgcgggtaggcatttccaattggattggtccaccccggaacaaatagggcagaaggcgattgtgcagaactttgctgatattgaggcgatgggtgcacgtccagtagccgcattgttggcgatttccgcccccacacacacccccgtggagtttgtccgaggcttagcccgtggcatgaatcaacgcttggaggagtactccgcggaacttgttggcggagacatcaccagcggggactccttggttattgctgtaactgcaattggtcaactgggtggatccttgccagagctgacgttgggacgtgcccgaccaggacagaccctggtggcccacggaaagatcggttactccgcagcaggccttgctctactgcagcactttggtccagacaacgttccagagcaccttcgccccttggtggatgcacactgcgcaccagttctcaccccaggccgaggcatggtggcacgcgctgctggagcgaccgccatgactgataactcggacggactgattgtggatcttaaccaaatggccatgaagtctggtgtgcgcatcgatgtggattcctgtagcatcagccccgatgaactccttagcgaagccgcttccgtactcggaacagacgcctggcgatggatcttaagcggcggggaagaccacaccctgctctctacgacgtttggcgatgccccctctggattccgcaccatcggccaagtcaccaaaacacgccacgaagacctcgtcaccgtagataagaaaacccccgcattttccgatggatggagaagcttctaatgaccaacaccctatggaat

SEQ ID NO: 524 - protein, 330 aa, Corynebacterium glutamicum
TLAHSLSFPDSLRDGPTVGDLGEFEVIRVITEQAGSSLNGDDAAVLRHASPNSRAVVTTDMLVAGRHFQLDWSTPEQIGQKAIVQNFADIEAMGARPVAALLAISAPTHTPVEFVRGLARGMNQRLEEYSAELVGGDITSGDSLVIAVTAIGQLGGSLPELTLGRARPGQTLVAHGKIGYSAAGLALLQHFGPDNVPEHLRPLVDAHCAPVLTPGRGMVARAAGATAMTDNSDGLIVDLNQMAMKSGVRIDVDSCSISPDELLSEAASVLGTDAWRWILSGGEDHTLLSTTFGDAPSGFRTIGQVTKTRHEDLVTVDKKTPAFSDGWRSF

SEQ ID NO: 525 - DNA, 706 bp, Corynebacterium glutamicum
  CDS (101)..(706): RXA01352
gtgcccaatgcattgggctgagattgcgcgctgttgctgcgcgggaccgttcgaacctgtctggttaacaccagcgaaggaagcgaggattgattgtcccgtgtttgaaaatcgttttgacctgcgttgttatgttgtgactggtgcgggctcggtggatgaggttgtgcacactgcgtctgctgcggctcgtggtggcgcgggtgtggtgcaggtgcgttcaaagcctatttcgccagaagcgatgagggagttggcatcaaaggttgcgcttgaggttgcgcggtgcagcccaacaacgagggtgcttatcgacgaccacctccacgttgcttcttccttaatgcgcgaaggactcccgattcacggtgtgcatcttgggcaggatgatatgtcggtgcttgaggctcgtgagttgttggggcctgaggcgatcattgggttgactactggaaccctagaacttgtggcggcggcgaatgagctgtccgatgtgttggattacatcggtgctgggccgtttcggaagactcccaccaaggattcaggtcggccaccgattggccttgcgggttatccccctttggtggaattgtccaaggtgccgatcgttgcgattggtgatgtcacccctgccgatgtgcgcgctctcagcgcaaccggtgtggctggcgttgccatggtgcgggctttttctgaatctgat

SEQ ID NO: 526 - protein, 202 aa, Corynebacterium glutamicum
VFENRFDLRCYVVTGAGSVDEVVHTASAAARGGAGVVQVRSKPISPEAMRELASKVALEVARCSPTTRVLIDDHLHVASSLMREGLPIHGVHLGQDDMSVLEARELLGPEAIIGLTTGTLELVAAANELSDVLDYIGAGPFRKTPTKDSGRPPIGLAGYPPLVELSKVPIVAIGDVTPADVRALSATGVAGVAMVRAFSESD

SEQ ID NO: 527 - DNA, 944 bp, Corynebacterium glutamicum
  CDS (1)..(921): RXA01381
tccgcaggcgttggaaccatcacggtcatcgatgacgacaccgtcgacatttccaacattcaccgccaaatcctcttcggcgcaagcgatgtcggtcgacccaaggtcgaggttgccgccgagcgcctcaaagaactccaaccagacatcaccgtcaacgcgttgcacgaacggatcactccagaaaacgcctgcgagctgctcaattccgtggacctcgtcttagacggctccgattctttctccacaaaatacttagtgtctgatgccgccgaaatcaccggaactcccctcatctgggcaacggtactgcgctttcacggcgaactggcactcttcaactctggccccgaccaccgcggagtcggcctgcgcgacgtcttccccgaacaaccctccgccgatttcgtccctgactgcgccaccgctggtgttcttggcgccaccacagccaccatcggcgcactcatggccactcacgccatcggatttctcacagaaatcggcgacgtccaaccaggcacaatcctctcctacgacgcattccccgccgccacgcgcagcttccgcgtctccgccgacccggcgcgcccactggtcacccgcctccgcgcctcctacgaggcagcgcgcaccgatacaacttcgcttatcgacgccaccctcaacggctccctcaccgccctcgatatccgagagccacatgaagttctgctcaaagacctccccgagggcgcaacgtcactgaagctccccttaagccagatcacctcggacagcgacattttagaggcactgtctggaatcgacggcgacattttggtctactgcgcttcgggaatccgcagttccgacttcatcgacaactactcccacctcggccacaaatttgtgaatcttcccggtggggtcaacgcgctgtagctgtcaatttaagaggccag

SEQ ID NO: 528 - protein, 307 aa, Corynebacterium glutamicum
SAGVGTITVIDDDTVDISNIHRQILFGASDVGRPKVEVAAERLKELQPDITVNALHERITPENACELLNSVDLVLDGSDSFSTKYLVSDAAEITGTPLIWATVLRFHGELALFNSGPDHRGVGLRDVFPEQPSADFVPDCATAGVLGATTATIGALMATHAIGFLTEIGDVQPGTILSYDAFPAATRSFRVSADPARPLVTRLRASYEAARTDTTSLIDATLNGSLTALDIREPHEVLLKDLPEGATSLKLPLSQITSDSDILEALSGIDGDILVYCASGIRSSDFIDNYSHLGHKFVNLPGGVNAL

SEQ ID NO: 529 - DNA, 259 bp, Corynebacterium glutamicum
  CDS (101)..(259): RXA01360
gtggcaatcaacgccgcggtcgtacccagatcccagtggtcacgcgccatttgtgacaacgattccgtagaagttctcaccgcaattcagggaggttaaaatgctgcatattgctgataaaactttcgattcccacctcatcatgggcaccggcggagccacctctcaggcgttgctggaggaatcccttgtcgccagtggaactcaattgaccaccgtggcgatgcgtcgacaccaagcaaccacctctagcggagaa

SEQ ID NO: 530 - protein, 53 aa, Corynebacterium glutamicum
MLHIADKTFDSHLIMGTGGATSQALLEESLVASGTQLTTVAMRRHQATTSSGE

SEQ ID NO: 531 - DNA, 629 bp, Corynebacterium glutamicum
  CDS (1)..(606): RXA01361
gccgacgctgtgatctctattgatggccacgatccgtgtttgaccgtgacgatgaattcgggggtgagggttgcgtcgaaaagcgttgttgttttggcggcgggcctgggcgccgcaagcattcccggctggtttgagggcgcgaacccattgcagttgaggccggtgtacggcgatattgtgcgcgtgcgcgtgccggagcgactgcagccgatggtcaccaaggtggtgcgcgggtttgtggaagatcgtcagatttatatcattccgcgtaccgatggcaccctcgcgatcggcgcgacaagccgtgaggatcacccgcaacctcgaacgggcgcagtgcatgatttgctacgcgatgctatccgtttgattccgggcattgaagaaaccgaatttatcgaagtcacctgcggcgcccgccccggcaccccggatgacctgccgtacctgggatgggttggatccaatgtgattgcgtccacaggatatttccgccatggaattttgctgtcagcccttggtgcacgcgctgccgttgatatggcaaccaaccagccactgttccccactcttgatgtgtgcgatccgtttcgccaccaaatttaaggatttttcacaagtgatta

SEQ ID NO: 532 - protein, 202 aa, Corynebacterium glutamicum
ADAVISIDGHDPCLTVTMNSGVRVASKSVVVLAAGLGAASIPGWFEGANPLQLRPVYGDIVRVRVPERLQPMVTKVVRGFVEDRQIYIIPRTDGTLAIGATSREDHPQPRTGAVHDLLRDAIRLIPGIEETEFIEVTCGARPGTPDDLPYLGWVGSNVIASTGYFRHGILLSALGARAAVDMATNQPLFPTLDVCDPFRHQI

SEQ ID NO: 533 - DNA, 927 bp, Corynebacterium glutamicum
  CDS (101)..(904): RXA01208
tactaggcacggggtgccaaccggatggaaaaattccggaggctgagaaaacacccgttgaacctgctctagctcgtactagcgaagggatggccttaacgtggctaactcgtttttggattctttaactcttgttcgacaaaacactccccttgttcagtgtttgaccaactctgtggtcatgcaattcacggccaatgtgttgcttgccgcgggtgcgacccctgcgatggtggatactccagctgaatcggcagaattcgccgctgtggccaatggagtgctcatcaatgcgggaactccttctgcggagcaataccaaggcatgaccaaggccattgagggtgcacgaaaagctggcacaccatgggtgttagacccagttgctgtgggtgggttgtcggagaggaccaagtatgcggagggaatcgtcgataagcagcctgccgcaattcgtggaaacgcctcagaggtcgtggcgcttgcggggctcggtgccggtgggcgcggcgtagacgcgaccgattccgtggaagtggcgttggaggcggcgcaattgttggccaagcgcactggtggcgtcgtggctgtctctggtgcggaggacttgattgtgtctgcggatcgggtgacgtggttgcgttcgggggatccgatgttgcagctggtgattggcactggatgctctttgggcgcgctgacagctgcatatctaggcgccacggttgactcagatatttccgcgcacgatgctgtgttggctgcgcatgcccatgtgggtgctgctggccagattgcagcacagaaggcatcggcgccaggcagctttgcggtggcgtttattgatgcgctttatgacgtggatgcccaggctgtggcctcgttggttgatgtgcgagaggcctgaaaagtacgtgactgattttt

SEQ ID NO: 534 - protein, 268 aa, Corynebacterium glutamicum
VANSFLDSLTLVRQNTPLVQCLTNSVVMQFTANVLLAAGATPAMVDTPAESAEFAAVANGVLINAGTPSAEQYQGMTKAIEGARKAGTPWVLDPVAVGGLSERTKYAEGIVDKQPAAIRGNASEVVALAGLGAGGRGVDATDSVEVALEAAQLLAKRTGGVVAVSGAEDLIVSADRVTWLRSGDPMLQLVIGTGCSLGALTAAYLGATVDSDISAHDAVLAAHAHVGAAGQIAAQKASAPGSFAVAFIDALYDVDAQAVASLVDVREA

SEQ ID NO: 535 - DNA, 1023 bp, Corynebacterium glutamicum
  CDS (101)..(1000): RXA00838
tcgtctaatagtgctgccaatccaccggccattgatgactcctttgtagagaaggggtagtgcttacaaatcttatctgtgctcaggcaagatagcaggtatgaaaattgcgatcgttggcgctggtgcagttggtggatatttcggagcgttgttacaagaatctggtgcagatatcacgatggttgcacgtggacgaacattagaagccttgaagtctaaaggactccacatcaacgatgcaagaggcgaacgctacgtaccaattcctgcagttgcgagcgtgcaagaactaaaagatgcagatgtagtgatgattgctactaaagcattatcgcggtctttagatctcgctgaacttttgggtgggatacctgcgaattcggtggtcgcgattactcagaattcgattgaatctgctgatctagcagcgaagagtatcggtgctgatcgtgtgtggcctggtgtggttcgtgggttctttgttcatgaggggccagcctcagtgtcatacaagggaggcccactgtcctacacgtttggtgattctggtgaactttctaggcaattcgcaagcactcttgaacaggccggtattgacggagttctgcatcccgatattttggtggatgtgtgggagaaagccatgttcgtagaggttttcggcgggttgggggctttcgtcgaaaagcaattaggtaccttgcgtacgcattttagggcttccctggaagccttgatggaagaggtggctgaggtggctcgcgcggcaggtgttgcgttgccgagcgatgcggtggagcgcaccatgaattttgcggatcggatgcctgagaattcgacgagttcgatgcagcgtgatttggccgcgggagtggctagtgagcttgaggctcagacaggtgcaattgtgcgggcagcgcacaaagtgggtgtgaaaactccgcttcatgaccttatttatgctggtcttaagctgaaagaagaggaaaattcactttagggatagaatcaagatccatg

SEQ ID NO: 536 - protein, 300 aa, Corynebacterium glutamicum
MKIAIVGAGAVGGYFGALLQESGADITMVARGRTLEALKSKGLHINDARGERYVPIPAVASVQELKDADVVMIATKALSRSLDLAELLGGIPANSVVAITQNSIESADLAAKSIGADRVWPGVVRGFFVHEGPASVSYKGGPLSYTFGDSGELSRQFASTLEQAGIDGVLHPDILVDVWEKAMFVEVFGGLGAFVEKQLGTLRTHFRASLEALMEEVAEVARAAGVALPSDAVERTMNFADRMPENSTSSMQRDLAAGVASELEAQTGAIVRAAHKVGVKTPLHDLIYAGLKLKEEENSL

SEQ ID NO: 537 - DNA, 693 bp, Corynebacterium glutamicum
  CDS (101)..(670): RXA02400
aggtgcccccaacgttgcctgttgactgcaaattttccgaaagaatccataaactacttctttaagtcgccagattaaagtcgtcaatgaaaggacatacatgtctatttcccgcaccgtcttcggcatcgcagccaccgcagccctgtctgcagctctcgttgcgtgttctccacctcaccagcaggattccccagtccagcgcaccaatgagatcttgactacttctcagaacccaacttctgcgagcagcacctcaacctcttccgcaacgactacttcctcagctcctgtggaagaggacgtagagatcgttgtttcaccagcagcgttggtggacggtgagcaggttaccttcgaaatctctggacttgatccagagggcggctactacgcagcgatctgcgattccgtagcgaaccctggtaacccagttccttcttgcaccggcgaaatggctgatttcacgtcccaggcatggttgagcaactcccagcccggcgcgactgtagagatcgcagaagacggcaccgcaactgtggagcttgaagctaccgcaaccggcactggcttggactgcaccactcaggcttgtgtagcgaaggtcttcggcgatcataccgaaggtttccgcgatgttgctgaagtcccagttactttcgcagccgcttaagttttcttaaaacgcactca

SEQ ID NO: 538 - protein, 190 aa, Corynebacterium glutamicum
MSISRTVFGIAATAALSAALVACSPPHQQDSPVQRTNEILTTSQNPTSASSTSTSSATTTSSAPVEEDVEIVVSPAALVDGEQVTFEISGLDPEGGYYAAICDSVANPGNPVPSCTGEMADFTSQAWLSNSQPGATVEIAEDGTATVELEATATGTGLDCTTQACVAKVFGDHTEGFRDVAEVPVTFAAA

SEQ ID NO: 539 - DNA, 1528 bp, Corynebacterium glutamicum
  CDS (101)..(1528): RXN01209
cagattgcagcacagaaggcatcggcgccaggcagctttgcggtggcgtttattgatgcgctttatgacgtggatgcccaggctgtggcctcgttggttgatgtgcgagaggcctgaaaagtacgtgactgatttttctttgtatctggtcaccgatcccgttttgggtggcgggccaaaaaaagtagctggaattgttgacagcgcaatttccggcggagtttctgtggtgcagctgcgcgataagaactcaggcgtggaagatgttcgtgcggcagcaaaggagctgaaagaactctgcgatgctcgcggggtggcgcttgttgtcaacgattacttagatatcgccgttgagctgggtcttcacctgcacattggtcaaggcgatacaccttatacgcaagcacgggagctgcttccagctcatcttgaattgggtttgagcattgaaaacctggatcaattgcatgctgtgatcgcgcagtgcgccgagactggtgtggcattgcccgatgtgattggcattggtccggtggcctctactgcgaccaaaccagatgcggcacccgcattgggtgtggagggcatcgctgagatcgccgctgtagctcaagaccacggcatcgcatcagtagctattggaggcgttggtctacgcaacgcggccgaactcgctgctacgcccatcgacggtctgtgcgtggtctctgaaatcatgaccgccgccaatccagcagctgcggcaactcgcctgcggactgcttttcaacctactttctcgcctgaaactcaaactgaactctctcaaacagaactccaaggagccttcgtgaattcgccttctgccccacgtgtgttgtctattgcaggcactgatcccacaggtggtgcaggtattcaggctgatctgaagtccattgcagcaggtggcggctacggcatgtgcgttgtgacctcgctggtcgcgcaaaacacccacggcgtcaacacgatccacaccccacccttgacctttttggaagaacagctggaagcggtcttttccgatgtcaccgtcgatgccatcaagctcggcatgttgggctctgccgacaccgtcgatctggtggcttcatggcttggttcccacgagcacggtcccgtggtgcttgatcccgtcatgatcgccaccagcggtgatcgcctactggatgcgagcgctgaagaatcgctgcgccgcctggccgtgcacgtcgatgtggtcaccccgaatatccccgaacttgccgtgttgtgcgacagtgctcctgccatcaccatggatgaggccattgctcaggctcagggatttgcgcggactcatgacaccatcgtcattgtcaagggtggacatctgactggcgcgcttgctgataacgctgtcgtgcgccccgacggctcggtgttccaggtggaaaacctgcgtgtcaacaccaccaactcccatggcacaggctgttcgctctctgcgtcacttgccaccaagatcgccgccggcgaaagcgtggaa

SEQ ID NO: 540 - protein, 476 aa, Corynebacterium glutamicum
MCERPEKYVTDFSLYLVTDPVLGGGPKKVAGIVDSAISGGVSVVQLRDKNSGVEDVRAAAKELKELCDARGVALVVNDYLDIAVELGLHLHIGQGDTPYTQARELLPAHLELGLSIENLDQLHAVIAQCAETGVALPDVIGIGPVASTATKPDAAPALGVEGIAEIAAVAQDHGIASVAIGGVGLRNAAELAATPIDGLCVVSEIMTAANPAAAATRLRTAFQPTFSPETQTELSQTELQGAFVNSPSAPRVLSIAGTDPTGGAGIQADLKSIAAGGGYGMCVVTSLVAQNTHGVNTIHTPPLTFLEEQLEAVFSDVTVDAIKLGMLGSADTVDLVASWLGSHEHGPVVLDPVMIATSGDRLLDASAEESLRRLAVHVDVVTPNIPELAVLCDSAPAITMDEAIAQAQGFARTHDTIVIVKGGHLTGALADNAVVRPDGSVFQVENLRVNTTNSHGTGCSLSASLATKIAAGESVE

SEQ ID NO: 541 - DNA, 1528 bp, Corynebacterium glutamicum; identical to SEQ ID NO: 539
  CDS (101)..(1528): FRXA01209

SEQ ID NO: 542 - protein, 476 aa, Corynebacterium glutamicum; identical to SEQ ID NO: 540

SEQ ID NO: 543 - DNA, 723 bp, Corynebacterium glutamicum
  CDS (101)..(700): RXN01413
tttgccctattggaagaagtaaattccacaccttcactttccaatacttcttttggtgagcgggtttcctcagcgtttaaccatctgaaaccatctgagattgacccatctgttcttagaactcgatgagcgtttagtactgggtgttcagcaagatggttaccaatggactgagcatttgttccggctgccactgcaacatctccgtaactcgcccaatgacctgcagggattgaagatacgatggtgtgaactttattccacaacggggaaagatcaaggggtagaacttctgcctcaagcaaccgtcgttaccccaaataacttcgaggcttccaccctctccggccttgagaagcttgagaccgtcgaggacctcaaggaggctgcccgcctcatttatgagcaaggcccccagtacgtagtcgtcaagggtggcatggacttccccggcgagaacgccgtggatgtgcttttcgacggatcctcctaccacgtcttctctgagccaaagattggtgaagagcgcgtttccggcgcagtctgcaccttcgcagctgttatcaccgcagagctagcaaagggtgctgaggttgtagacccagtggcaaccgcaaagcgtgtggtcacccgtgcggttcaagatgctgttgcatccaacgcaccttttacctccgtatggcttgctgaggacaacaagtagagttttaaaataccgatcaa

SEQ ID NO: 544 - protein, 200 aa, Corynebacterium glutamicum
LTHLFLELDERLVLGVQQDGYQWTEHLFRLPLQHLRNSPNDLQGLKIRWCELYSTTGKDQGVELLPQATVVTPNNFEASTLSGLEKLETVEDLKEAARLIYEQGPQYVVVKGGMDFPGENAVDVLFDGSSYHVFSEPKIGEERVSGAVCTFAAVITAELAKGAEVVDPVATAKRVVTRAVQDAVASNAPFTSVWLAEDNK

SEQ ID NO: 545 - DNA, 795 bp, Corynebacterium glutamicum
  CDS (101)..(772): RXN01617
tcagaagctaccggcggcgccggcatccaggttgatttgaagaccttccagcatttaagatgtttatggcattgggtccatcacatgcttgggtggccttttgatcctaaagacaactggaatcaccgttttgtcccggtttgatgcgcaggttatcgctaatcagattgaggccgccaccgcagcgcacgatcttgatgtggtgaagatcggtatgttgggtactcctgcaacgatcgatactgtggcaaccgctttggaggaaaacagcttcaagcacgttgtcctagacccggtactgatctgcaagggccaggagcccggcgcggcacttgatactgacactgcccttcgcgcgaaggtgctgccacaggcaaccgtggttactccaaacaacttcgaggccaccaccctgtctggcctagacaagctggagaccatcgacgacctgaaggaagcagcccgcctcattcatgagcaaggacctcagtacgtcgttgttaagggtggcatcgacttcccaggcgacaacgctgtggacgtacttttcgacggcaccgactaccacgtgttctctgaaccaaagatcggcgacgagcgcgtctccggcgctggctgtaccttcgcagctgtcatcaccgcagagctggccaagggcaactctgccgttgatgcagtgaccaccgctaagcgcgtagtcacccgcgcagtgaaggacgctgtcgcatccaacgcaccgtttacctctgtgtggttggcggaagacaacaagtagaaatcttaaacaagctccct

SEQ ID NO: 546 - protein, 224 aa, Corynebacterium glutamicum
LILKTTGITVLSRFDAQVIANQIEAATAAHDLDVVKIGMLGTPATIDTVATALEENSFKHVVLDPVLICKGQEPGAALDTDTALRAKVLPQATVVTPNNFEATTLSGLDKLETIDDLKEAARLIHEQGPQYVVVKGGIDFPGDNAVDVLFDGTDYHVFSEPKIGDERVSGAGCTFAAVITAELAKGNSAVDAVTTAKRVVTRAVKDAVASNAPFTSVWLAEDNK

SEQ ID NO: 547 - DNA, 638 bp, Corynebacterium glutamicum
  CDS (1)..(615): FRXA01617
gctaatcagattgaggccgccaccgcagcgcacgatcttgatgtggtgaagatcggtatgttgggtactcctgcaacgatcgatactgtggcaaccgctttggaggaaaacagcttcaagcacgttgtcctagacccggtactgatctgcaagggccaggagcccggcgcggcacttgatactgacactgcccttcgcgcgaaggtgctgccacaggcaaccgtggttactccaaacaacttcgaggccaccaccctgtctggcctagacaagctggagaccatcgacgacctgaaggaagcagcccgcctcattcatgagcaaggacctcagtacgtcgttgttaagggtggcatcgacttcccaggcgacaacgctgtggacgtacttttcgacggcaccgactaccacgtgttctctgaaccaaagatcggcgacgagcgcgtctccggcgctggctgtaccttcgcagctgtcatcaccgcagagctggccaagggcaactctgccgttgatgcagtgaccaccgctaagcgcgtagtcacccgcgcagtgaaggacgctgtcgcatccaacgcaccgtttacctctgtgtggttggcggaagacaacaagtagaaatcttaaacaagctccct

SEQ ID NO: 548 - protein, 205 aa, Corynebacterium glutamicum
ANQIEAATAAHDLDVVKIGMLGTPATIDTVATALEENSFKHVVLDPVLICKGQEPGAALDTDTALRAKVLPQATVVTPNNFEATTLSGLDKLETIDDLKEAARLIHEQGPQYVVVKGGIDFPGDNAVDVLFDGTDYHVFSEPKIGDERVSGAGCTFAAVITAELAKGNSAVDAVTTAKRVVTRAVKDAVASNAPFTSVWLAEDNK

SEQ ID NO: 549 - DNA, 915 bp, Corynebacterium glutamicum
  CDS (101)..(892): RXS01807
gctcaccgagctggacaccaagctccgcgcagtgcaggaagaacacggcgagctggaaatgcagtggctggaactcggcgaggaaatcgagggctagttcatgccgtcggcaggcgaggagattttagagcagcgcgcacagctggagtttgatcagcgccgcgccgatgtggtgatgatcggcagccaggtggtttatggttccgtggggctcagtgctgccattccggtgatgcacaacgaaggcctccgcgtggtcgctgtccccaccgtggtgttaagttccatgccgcgttatgcaagttctcaccgccagccgatgtcggaccaatggctcgccgacgcgctgcaagacctggtggatctggggattatcgatgaggtttccaccatttccaccggctattttacctccgcttctcaggtgcgtgtggtcgctgcgtggctgcagaaaatccgcgaaacccatccgcatgtgcgcatcgtggtggatcccatcatgggggacagtgacgtgggaatttatgtcgccgacgagatcgcaaccgccatctgccaggacttatgccctctggctaccggaatcattcccaatgctttcgagctctcccacatggttggctccggcgatccgcgctcgctgctcggcccgtttggcgagtggatcatcatcaccagcgccactgaaactgtgggcaccaccgtcacccgcatcgtcacccgtgacagcgtccaggaaatcgcctccgccaccgtcgataccacggccaaaggggcaggcgacgtctacgccgcagcattaatcgccgccctgcataaagatttttcgcttatcgacgccgccagccacgcatccaacaccgtctgcgccggcctgcagaccaaagcgctttaggtttcgtccgtctctgacag

SEQ ID NO: 550 - protein, 264 aa, Corynebacterium glutamicum
MPSAGEEILEQRAQLEFDQRRADVVMIGSQVVYGSVGLSAAIPVMHNEGLRVVAVPTVVLSSMPRYASSHRQPMSDQWLADALQDLVDLGIIDEVSTISTGYFTSASQVRVVAAWLQKIRETHPHVRIVVDPIMGDSDVGIYVADEIATAICQDLCPLATGIIPNAFELSHMVGSGDPRSLLGPFGEWIIITSATETVGTTVTRIVTRDSVQEIASATVDTTAKGAGDVYAAALIAALHKDFSLIDAASHASNTVCAGLQTKAL

SEQ ID NO: 551 - DNA, 622 bp, Corynebacterium glutamicum
  CDS (101)..(622): RXC01021
cgagaggcttttttggctctaagccttttagtcgtgcgaacgaaatcttaagcagcctcggtgccaccgagatcgattggtcgctgtaaggtatctgattatgtccagttccgaaagctcgcgttccgaaggctcgcagccagcaccgtctgtacagcctgaacgccgtgctgattcaacgggggctcctgcggcagcttccaaggaagcttcccaacaaatggacgctgccggagttcttgagtgggccaggaccgctgtcgagcagctttctgaacgtcgtgcagagatcaatgcactgaatgtctttcctgttccagatgcagacactggatcaaacatgacctacaccatgacagctgcgttggatgaagcgctgaaactgggggagttgggtgatgtcgcaaggattactgaggctttggctgttggttctgtgcgtggagcccgaggaaattctggagtagtccttagtcaggtccttcgcgctattgctcaggcagctgctgacggggttattgatggccacacaatccaagaagcgctatccattgctcgctccctagttgatcgcgcaattacagatcctgtggagggcactgttgtcactgtgttgcgttct

SEQ ID NO: 552 - protein, 174 aa, Corynebacterium glutamicum
MSSSESSRSEGSQPAPSVQPERRADSTGAPAAASKEASQQMDAAGVLEWARTAVEQLSERRAEINALNVFPVPDADTGSNMTYTMTAALDEALKLGELGDVARITEALAVGSVRGARGNSGVVLSQVLRAIAQAAADGVIDGHTIQEALSIARSLVDRAITDPVEGTVVTVLRS

SEQ ID NO: 553 - DNA, 1107 bp, Corynebacterium glutamicum
  CDS (101)..(1084): RXN02246
tgccgacgctggcgtggatgccttcgttgcaggttccgctgtgtacggcgctgaggatcccaacaaggcgatccaggagttgcgagcactcgcgcagtaaatggatgttgcgcacgcgttagatctggcccaccacgtgtcagatcaagtccgaggcaccaccagccctaatccgccagtcggcgctgtcattttggacgccgacggcgaggtcgttggcgttggcgccacggcacctcctggtggcccgcacgccgaagtggtggcgcttgcagctgccggagtgcgtgccaacgggggcacggcggtggtcaccctcgagccgtgcaaccattacggccgcacgggtccatgttccaaggcgcttctcgacgccgggatcgcacacgtgttttacgccaatgcggatcccttcccgtcagccgctgggggcggtgcctttttggcggaggcgggcgtcgatacgcattttttagatgagcggatcagggcactggagccctggctggttgcgacgcgtctgggcaggccccatgtcacgttgaagtttgcgtccaccgtggacggttttgctggtgccaccgatggcaccagccagtggattaccgggccggatgcgcgggcgtttgtgcacgaagatcgaagtaaaagagatgcgatcatcgtgggtaccggtactgcgttgactgataatccctccttgacggcgcggaccgatacgggtctttatgaaaatcaacccaggcgcgttgttattggctcccgcgaggttccagcagattccaacttggctcgcttgggatatgagcagtacgcgggaataccagaggctttatcagcgctgtgggataaagggtgccgagacattttaatcgaaggtggcccaacgttagctggggcagcgctgcgcttaggcattgttgatcaggtgcaggcctatgttgcccccgctttgttgggcgctggacgatcagtgattaactggccacaagaaaccacgatggatcagattatgcgttttgacaccacgtccgtgagacagttgggttcagatgtattgatagaaatgatgagaaaggaacactaaatgttcacaggtattgtcga

SEQ ID NO: 554 - protein, 328 aa, Corynebacterium glutamicum
MDVAHALDLAHHVSDQVRGTTSPNPPVGAVILDADGEVVGVGATAPPGGPHAEVVALAAAGVRANGGTAVVTLEPCNHYGRTGPCSKALLDAGIAHVFYANADPFPSAAGGGAFLAEAGVDTHFLDERIRALEPWLVATRLGRPHVTLKFASTVDGFAGATDGTSQWITGPDARAFVHEDRSKRDAIIVGTGTALTDNPSLTARTDTGLYENQPRRVVIGSREVPADSNLARLGYEQYAGIPEALSALWDKGCRDILIEGGPTLAGAALRLGIVDQVQAYVAPALLGAGRSVINWPQETTMDQIMRFDTTSVRQLGSDVLIEMMRKEH

SEQ ID NO: 555 - DNA, 1107 bp, Corynebacterium glutamicum; identical to SEQ ID NO: 553
  CDS (101)..(1084): FRXA02246

SEQ ID NO: 556 - protein, 328 aa, Corynebacterium glutamicum; identical to SEQ ID NO: 554

SEQ ID NO: 557 - DNA, 756 bp, Corynebacterium glutamicum
  CDS (101)..(733): RXA02247
acaagaaaccacgatggatcagattatgcgttttgacaccacgtccgtgagacagttgggttcagatgtattgatagaaatgatgagaaaggaacactaaatgttcacaggtattgtcgaggagcttggctccgttgcaggcgtggaacatctgggagattccatccggatgcagatttccgcgtccaccgttttagagggtgtgcatttgggggattccatttctgtcaatggtgtgtgcttgacagtggcgtcctttggcgagggacatttcactgcagacctcatgcaggaaaccttagatcgcagctccctgggcgcattatccaccggtagcaaagtcaaccttgagcgcgccatggcagccgatggccgtctgggtggacacatcatgcaaggccatgttgatgccaccacctcgctgatcaagcgcaccagctcagagaactgggatgttctgcgttttgagctgccagctgatttggctcgctatgtggtggaaaaaggctccatcgcactcaatggcacatccttgactgtatcgtctttgggtgatgattggtttgaggtttccctgattcccaccaccttgcgcgacaccacccacggcgaactggcggtaggggatatcgtaaacattgaggttgatgtgatcgctaagtacgtcgaacgcatgatgacgcgcggcgtggctggaaacactcccaatgactacaccgatttcacgagagactaggttagacaacgtgagtgaac

SEQ ID NO: 558 - protein, 211 aa, Corynebacterium glutamicum
MFTGIVEELGSVAGVEHLGDSIRMQISASTVLEGVHLGDSISVNGVCLTVASFGEGHFTADLMQETLDRSSLGALSTGSKVNLERAMAADGRLGGHIMQGHVDATTSLIKRTSSENWDVLRFELPADLARYVVEKGSIALNGTSLTVSSLGDDWFEVSLIPTTLRDTTHGELAVGDIVNIEVDVIAKYVERMMTRGVAGNTPNDYTDFTRD

SEQ ID NO: 559 - DNA, 1389 bp, Corynebacterium glutamicum
  CDS (101)..(1366): RXN02248
gatgtgatcgctaagtacgtcgaacgcatgatgacgcgcggcgtggctggaaacactcccaatgactacaccgatttcacgagagactaggttagacaacgtgagtgaacatgagcaggcacacagccaattagattctgttgaagaggccatcgctgacatcgctgcgggtaaagccgtcgtggtggtagatgatgaagatcgtgaaaatgaaggcgacatcatctttgccgccgaattagccactccagaattagtcgctttcatggtgcgttattcctcgggatacatctgtgcgccattaaccgcaaaggatgcagatcgtcttgatctgcctccgatgaccgcgcacaatcaggatgcccgcggcaccgcttacaccgtgaccgttgatgccaacaccggcaccacaggcatttctgcaacagaccgcgcccacactttgcgcttgcttgctgatccagaagccgaccgcacggatttcacccgtcccggacacgttgtgccactgcgtgctcgtgaaggtggcgtcttggtgcgcgctggacacaccgaagcagctgtcgatttggctcgcgctgcaggcctgcgcccagcaggtgttatctgcgaagtggtcagtgaagaggaccccaccggcatggctcgggttcctgagctgcgccgcttctgcgatgagcacgatctgaagctgatctctattgagcagctcattgagtggcgtcgcaagaatgaaattttggtggagcgccaggtggaaactgtgctgcctaccgatttcggcacgttcaaggctgttggttaccgttccatcatcgatggcaccgagcttgttgccattgttgccggcgacgtggcatccgacggtggcgaaaacgtcctggttcgagtccactctgagtgcttgactggtgatgtttttggatcccggcgctgcgactgtggacagcagctgcacgagtctttgcgcctgatccaggaagctggtcggggagtagtggtgtacatgcgtgggcatgagggacgaggcattggtctgctcgccaagctacgcgcctaccaactccaggatgaaggtgccgacaccgtcgatgccaacctcgcacttggtcttccagccgatgcccgcgaatttggcaccagcgcccagattctctacgacttgggtgtgcgctcgctcaacttgatcagcaacaacccagccaagaaggtgggacttgaaggccacggcatttccattgccagccgaacccccatccctgttgctgttcatgaagacaatgttcgatacctgaaaaccaagcgtgaccgcatgggacatgacctcccagatgtcgcactgtgggaacaagagcacccagaaaactaaggagcacaacaatggctaaa

SEQ ID NO: 560 - protein, 422 aa, Corynebacterium glutamicum
VSEHEQAHSQLDSVEEAIADIAAGKAVVVVDDEDRENEGDIIFAAELATPELVAFMVRYSSGYICAPLTAKDADRLDLPPMTAHNQDARGTAYTVTVDANTGTTGISATDRAHTLRLLADPEADRTDFTRPGHVVPLRAREGGVLVRAGHTEAAVDLARAAGLRPAGVICEVVSEEDPTGMARVPELRRFCDEHDLKLISIEQLIEWRRKNEILVERQVETVLPTDFGTFKAVGYRSIIDGTELVAIVAGDVASDGGENVLVRVHSECLTGDVFGSRRCDCGQQLHESLRLIQEAGRGVVVYMRGHEGRGIGLLAKLRAYQLQDEGADTVDANLALGLPADAREFGTSAQILYDLGVRSLNLISNNPAKKVGLEGHGISIASRTPIPVAVHEDNVRYLKTKRDRMGHDLPDVALWEQEHPEN

SEQ ID NO: 561 - DNA, 1389 bp, Corynebacterium glutamicum; identical to SEQ ID NO: 559
  CDS (101)..(1366): FRXA02248

SEQ ID NO: 562 - protein, 422 aa, Corynebacterium glutamicum; identical to SEQ ID NO: 560

SEQ ID NO: 563 - DNA, 600 bp, Corynebacterium glutamicum
  CDS (101)..(577): RXN02249
atgttcgatacctgaaaaccaagcgtgaccgcatgggacatgacctcccagatgtcgcactgtgggaacaagagcacccagaaaactaaggagcacaacaatggctaaagaaggattgccggcagtcgaactccccgacgccagcggattaaaagtcgccgtagtcaccgcacggtggaacgcagaaatctgcgaccgcctgcacaagcacgcagtagatgcgggacgtgcagcaggagcaacggtgagcgaataccgcgtcatcggcgccctggaacttccagtcgtagtgcaagaactggcacgcacccatgacgcagtagttgccttgggctgtgtcgttcgtggcggcaccccacactttgattacgtgtgcgactctgtcaccgaaggcctcacccgcattgctcttgatacttccaccccaatcggcaacggtgtgttgactaccaacaccgaagagcaagccgtggaacgctccggtggagaaggctctgtagaggacaaaggcgcagaggcaatggtcgctgcactcgatactgccctcgtgctttctcaaattcgtgcaactgagggttagactgttctttaaaaggtttg

SEQ ID NO: 564 - protein, 159 aa, Corynebacterium glutamicum
MAKEGLPAVELPDASGLKVAVVTARWNAEICDRLHKHAVDAGRAAGATVSEYRVIGALELPVVVQELARTHDAVVALGCVVRGGTPHFDYVCDSVTEGLTRIALDTSTPIGNGVLTTNTEEQAVERSGGEGSVEDKGAEAMVAALDTALVLSQIRATEG

SEQ ID NO: 565 - DNA, 600 bp, Corynebacterium glutamicum; identical to SEQ ID NO: 563
  CDS (101)..(577): FRXA02249

SEQ ID NO: 566 - protein, 159 aa, Corynebacterium glutamicum; identical to SEQ ID NO: 564

SEQ ID NO: 567 - DNA, 702 bp, Corynebacterium glutamicum
  CDS (101)..(679): RXA02250
caactgagggttagactgttctttaaaaggtttgacgcctcggtttaatgcctagcaggatgcgcgccaccgctaattagttctaaggatttgtgaaatcgtgacaaccaacgcccccgacggagcaacgaacaacatcaacaacgcacattcgggcgctgtcgggaagccaaaggtacagctcagcgatgcggaaattcaggaatacaccgcagctttcgctggcaccaccacaaccaagccatgggagctggaggtgaccacaaagtttctgaaaaagatcgcgtgggtagccgtggttgtcatcatggccgttcacatcttcatgggtgccgtggtggacgtcgatttcaccggtgcagcggtcacctttgttgacactctggcattcccagcgttgggcatcatcttctccgttcttgtgttcttgggactgactcgccctcgcgtgcgtgccaacgaagacggcgttgaggtgcgtaacttcatcggaactcgtttctacccatgggttgtcatctacggcatgtctttccccaagggcagcagcgtggcacgtttggagcttccagactttgaattcgttcccatgtgggctttccagtcccgcgatggagaagatgtggtgcgcgcggttgcgaccttccgcgacctcgaaaacaagtacatgccagaggactaattaagctgtggctgatccaa

SEQ ID NO: 568 - protein, 193 aa, Corynebacterium glutamicum
VTTNAPDGATNNINNAHSGAVGKPKVQLSDAEIQEYTAAFAGTTTTKPWELEVTTKFLKKIAWVAVVVIMAVHIFMGAVVDVDFTGAAVTFVDTLAFPALGIIFSVLVFLGLTRPRVRANEDGVEVRNFIGTRFYPWVVIYGMSFPKGSSVARLELPDFEFVPMWAFQSRDGEDVVRAVATFRDLENKYMPED

SEQ ID NO: 569 - DNA, 1146 bp, Corynebacterium glutamicum
  CDS (101)..(1123): RXA01489
gtcatgggatgtcattccggcgggcttgtcgacgatcacgagtccaggtttaggggcaggagcattcatgtctgttgagtctatgccgtagtctaaaacagtggatatttggagtggactagacagcgttccggctgatcttcaaggatcagtagtcaccattggtgtgtttgatgggctccaccgggggcatcaaagtttaatcggcgaggccaagaagcaggccgaggagctgggtgtgccttgtgtcatggtgacctttgacccgcatccgatcgctgtgtttttgccaggtaaagagccaacccgtttggctcctttggattatcgccttaatttggctgcggaatgtggcgtcgatgctgcgttggttattgatttcactaaagaactcgcaggtctgagcgctgaagagtatttcacaaccatgatcgtggatacgctgcatgcgcgttcagttgtggtgggggagaacttcaccttcggtgtcaatggcgctggcactgagtccacgatgcgggaattgggacaaaagtttggcgtgaatgtcacgattgctccgctgctgcatgatgatgaccagcgtatttgctccaccttggtgcgcgattacttggatcagggcgaggttgagcgcgcgaactgggcgcttggtcgacgctatgccgtgcgcggcgaagttgtccgtggtgctggccgtggcggcaaagaattgggctatcccaccgcgaatctctacctgccgacctctgtggcgctgcccgccgatggcgtgtatgcaggctggttcaccatcaccgatgaccgcgaaatcgacaaggaaatctcccgcgatatcgacggcaccatggttccaggcgtgcgttaccaaactgccatttccgtgggcaccaatcccaccttcggcgatgagcgacgcagcgtcgaggcattcatcctcgaccaggaagccgacctgtacggtcaccatgtcatggtggaattcgtgggacacttgcgcgacatggtcaaattcaacggcgtcgacgagctactagacgccatggcccgagatgtcaccaacgcccgcgacatccttgccaaagacaaattgcttctcgacgccgacacccagcccagcgcttaaggccggtcaccggccatcaa

SEQ ID NO: 570 - protein, 341 aa, Corynebacterium glutamicum
VDIWSGLDSVPADLQGSVVTIGVFDGLHRGHQSLIGEAKKQAEELGVPCVMVTFDPHPIAVFLPGKEPTRLAPLDYRLNLAAECGVDAALVIDFTKELAGLSAEEYFTTMIVDTLHARSVVVGENFTFGVNGAGTESTMRELGQKFGVNVTIAPLLHDDDQRICSTLVRDYLDQGEVERANWALGRRYAVRGEVVRGAGRGGKELGYPTANLYLPTSVALPADGVYAGWFTITDDREIDKEISRDIDGTMVPGVRYQTAISVGTNPTFGDERRSVEAFILDQEADLYGHHVMVEFVGHLRDMVKFNGVDELLDAMARDVTNARDILAKDKLLLDADTQPSA

SEQ ID NO: 571 - DNA, 1197 bp, Corynebacterium glutamicum
  CDS (101)..(1174): RXA02135
cgtgtcgcagcgatttgcgagagggttgtcttcgtggttgctggtctgccactagagttgaaaacgttttaagaaaacagtcggtttgaaggagttgttaatggttccagcagagctttttgcgcgtgtggaatttccggatcataaaatcctggctcagacgaaggatttccatgactccctcaccaagccacccggatctttgggcaagttggagcagatcggctgtttcatttccgcatgccagggccagattccgccacgtccactcaacaactcaaagatcgttgttttcgctggcgatcacggcgttgcaactaaaggcgtgtccgcgtacccatcctcagtaagcttgcagatggctgaaaacattacaaacggtggcgccgccatcaacgtgattgcacgcaccaccggcacgtccgtccgacttattgatacctccctcgaccacgaagcatggggcgacgagcgcgtatctaggtcctgcggatccatcgatgttgaagacgccatgacccaagaacaggtcgaacgcgcactgaagatcggtaagcgcattgcggatcaagaagtggacgcaggcgccgacattttaatccccggcgatttaggaattggcaacaccaccaccgccgctgccctcgttggaacgttcaccctcgcagagcctgttgttgtcgtaggccgcggcaccggaatcgacgatgaagcctggaaactcaaagtctccgcgatccgcgacgccatgttccgcgcccgcgacctgcgccaagaccccatcgccatcgcccggaaaatctcttccccagaccttgcagccatggcagcattcattgcccaagcagcagttcgacgcacccccgtgcttctcgacggcgttgtagtcaccgccgcagccctcctagccaacaaactggccccaggtgccaggcgttggttcatcgcaggacaccgctccaccgaaccagcgcattccgtagctctaaacgcactggcccttgatcccatcctggaacttggaatgtcccttggcgaaggctccggcgcagccaccgcactccccctggtcaagattgccgttgacctgatgaacgacatgtcgacattttcttccgccggcgtcgatggacccctaaacgcctcttccgaagcgcccgagcaaaacacggagtaactttctaagcgatgtccggc

SEQ ID NO: 572 - protein, 358 aa, Corynebacterium glutamicum
MVPAELFARVEFPDHKILAQTKDFHDSLTKPPGSLGKLEQIGCFISACQGQIPPRPLNNSKIVVFAGDHGVATKGVSAYPSSVSLQMAENITNGGAAINVIARTTGTSVRLIDTSLDHEAWGDERVSRSCGSIDVEDAMTQEQVERALKIGKRIADQEVDAGADILIPGDLGIGNTTTAAALVGTFTLAEPVVVVGRGTGIDDEAWKLKVSAIRDAMFRARDLRQDPIAIARKISSPDLAAMAAFIAQAAVRRTPVLLDGVVVTAAALLANKLAPGARRWFIAGHRSTEPAHSVALNALALDPILELGMSLGEGSGAATALPLVKIAVDLMNDMSTFSSAGVDGPLNASSEAPEQNTE

SEQ ID NO: 573 - DNA, 1146 bp, Corynebacterium glutamicum; identical to SEQ ID NO: 569
  CDS (101)..(1123): RXA01489

SEQ ID NO: 574 - protein, 341 aa, Corynebacterium glutamicum; identical to SEQ ID NO: 570

SEQ ID NO: 575 - DNA, 805 bp, Corynebacterium glutamicum
  CDS (87)..(782): RXN01712
gccggcttaggctcctccgaccagaaccccactggcacctttggataacaccattccgtgtaaacaagctggcctagacttgaaacatggtcgatatcttggaactcatcggtcccctaccttttgtgtctacgccagagttaagggcaattgtcgtgactgccattaatggttccaccactattaatggcacgtctggtcagcttggaaattccacggatacggaacttctgttggcgcttcgcaggtggtcggacgtggtgttggttgggtcgagcacggtgaaggctgaaaattatggtggcgtggaggtttcgcctgaaatccagaagcaacgccaggagttgggtcaggaagcgattccgccgattgcggtgatgtcagggtcgttgaattttgatgtggatactcgctttttccttgaggccgaagtgccgccgatcatcatcacggataattccgatcaagcaaagcagcagcggcttgtggatgctggggctcaggttattgaggtggagacgttgacggcggaggttggcgtcgaaaagcttaggtctttgggttacgcccgcattgattgtgagggcggtgcaacgttgtatgggcagatgttggccgccgatcttgttgatgtgtggcatcacacgattgatccgacgttgtcgggcagcgtggagcgccccacggtgaagggcggcgatgatgcgccgcgccgattcgcgttggagcacgtctttgtcgatgatgacagcaccctattcttgcggtataagcgcgccaagtgagtgttggactctccggatct

SEQ ID NO: 576 - protein, 232 aa, Corynebacterium glutamicum
MVDILELIGPLPFVSTPELRAIVVTAINGSTTINGTSGQLGNSTDTELLLALRRWSDVVLVGSSTVKAENYGGVEVSPEIQKQRQELGQEAIPPIAVMSGSLNFDVDTRFFLEAEVPPIIITDNSDQAKQQRLVDAGAQVIEVETLTAEVGVEKLRSLGYARIDCEGGATLYGQMLAADLVDVWHHTIDPTLSGSVERPTVKGGDDAPRRFALEHVFVDDDSTLFLRYKRAK

SEQ ID NO: 577 - DNA, 578 bp, Corynebacterium glutamicum
  CDS (55)..(555): FRXA01712
cttctgttggcgcttcgcaggtggtcggacgtggtgttggttgggtcgagcacggtgaaggctgaaaattatggtggcgtggaggtttcgcctgaaatccagaagcaacgccaggagttgggtcaggaagcgattccgccgattgcggtgatgtcagggtcgttgaattttgatgtggatactcgctttttccttgaggccgaagtgccgccgatcatcatcacggataattccgatcaagcaaagcagcagcggcttgtggatgctggggctcaggttattgaggtggagacgttgacggcggaggttggcgtcgaaaagcttaggtctttgggttacgcccgcattgattgtgagggcggtgcaacgttgtatgggcagatgttggccgccgatcttgttgatgtgtggcatcacacgattgatccgacgttgtcgggcagcgtggagcgccccacggtgaagggcggcgatgatgcgccgcgccgattcgcgttggagcacgtctttgtcgatgatgacagcaccctattcttgcggtataagcgcgccaagtgagtgttggactctccggatct

SEQ ID NO: 578 - protein, 167 aa, Corynebacterium glutamicum
VKAENYGGVEVSPEIQKQRQELGQEAIPPIAVMSGSLNFDVDTRFFLEAEVPPIIITDNSDQAKQQRLVDAGAQVIEVETLTAEVGVEKLRSLGYARIDCEGGATLYGQMLAADLVDVWHHTIDPTLSGSVERPTVKGGDDAPRRFALEHVFVDDDSTLFLRYKRAK

SEQ ID NO: 579 - DNA, 831 bp, Corynebacterium glutamicum
  CDS (101)..(808): RXN02384
ctgatgaggcggatatccgcaacatcgacagcattgatgaactcccacctttgccagctgaatacgagcctggctacgaggacgattaagaggtagtcctgtgactcgtcgcctgattctgctccgacacgggcagactgaatacaacgccacgtcccgaatgcagggacaattggacacagagctgtctgacctgggctttcaacaggcggccagcgcagcctcagtgctggttcaaaaaaacatcacccatgtgttcagctcggatctttcccgcgccttcaacaccgcaagcgcggttgcggcgctgattgacgcggaggtgcgcgtcgataagcgtcttcgggaaacgcatttgggtgagtggcaggccaaaacccacactgaggtggattccgaatatccaggtgcgcgcgctcaatggcgccacgatccgcagtgggcaccacccggcggcgaatcgcgcgtggatgttgcgcgccgggcacgccaagttgtcgacgagttgatggtgtcgcttgatgattgggatgaaggcaccgtgctcatcgtggctcacggtggcacgattaatgcgctgacctcgaatcttttggacctggcgtatgatcagtaccccatgttctctggacttggaaatacctgttgggcacaattgaccgcccgacctcgctattatgcaggtagtgagaacccagaagatgacctcaagatttcttcggcggtttccaacagccctcattttgagggcaacaatgtggaaaacgcccagtggtatcttgacggctggaacatgggtgttacgcagtaaagaagatggcaataaaaatg

SEQ ID NO: 580 - protein, 236 aa, Corynebacterium glutamicum
VTRRLILLRHGQTEYNATSRMQGQLDTELSDLGFQQAASAASVLVQKNITHVFSSDLSRAFNTASAVAALIDAEVRVDKRLRETHLGEWQAKTHTEVDSEYPGARAQWRHDPQWAPPGGESRVDVARRARQVVDELMVSLDDWDEGTVLIVAHGGTINALTSNLLDLAYDQYPMFSGLGNTCWAQLTARPRYYAGSENPEDDLKISSAVSNSPHFEGNNVENAQWYLDGWNMGVTQ

SEQ ID NO: 581 - DNA, 453 bp, Corynebacterium glutamicum
  CDS (101)..(430): RXN01560
atgggagcaaggctcatttagctacttcgacgtggaagcgcacatcgttgagttgattcctgcatcagtaagcgatgcgttttaggcacatctgcgatccgtgggcgtgtcctacatcatcgccggcgatgagcagctggatatggcagaagccgttcgcaaaattggggagacctttaaaactgaggaaattatccttggtggcggaggaaccctgaactggtccatgctccgcgacggtttgtgcgacgaggttagcatcgtgatgatgccaatcgccgatggtgaaaagcacacccactctttgttcgaagccgatgaaaaatactcagcaccgttgccgatcggtttttcactcgccagcgttgaaccactagaagatggaagcgtttggatgcgttacggggtcaatggcccagtggacgcgaactaggtagcaaatactcgctcttt

SEQ ID NO: 582 - protein, 110 aa, Corynebacterium glutamicum
VGVSYIIAGDEQLDMAEAVRKIGETFKTEEIILGGGGTLNWSMLRDGLCDEVSIVMMPIADGEKHTHSLFEADEKYSAPLPIGFSLASVEPLEDGSVWMRYGVNGPVDAN

SEQ ID NO: 583 - DNA, 1137 bp, Corynebacterium glutamicum
  CDS (101)..(1114): RXN00667
ggcatcagtgtttgaagggaaaagcaggtcaaacaaggtgcggctgatttgagcgatcacagcaccgagatctgtgctgaagaattcaatgattgggttgatgattgcgttgaagtccatgtctaacagggtagtacaaaagccaaaaatgaaagcgccgctacccatccgcgacggcctcaacccttcccgtgtgcgcttgccgctcgacgcggcgccgatccgcgccatcgattttgttgaatacctcatttccacgcagcgccaccgcaatccggccgacaacgccgaagcgcttcaagcgcgtttcgacgccgaccttgttgtcaaccactacggcgagccctacgcccccgacaccatggttcagcccgacgacgacatttggttctaccgcatgcccgccgccgaacggccgatcccttacaaaattcatgtcattcacgaagacgatgacatcctcgtcattgacaagccaccctacctagcaaccatgcctcgtggccgccacatcaccgaaaccgctctggtgaaaatgcgtgtgctgactggaaacaacgatctcaccccagctcaccgcctcgatcgcctgacttccggtgtgttagtcatggtgaaaaaaccagaactccgtggcgcttaccaaaccttgtttgcccgacgtgaggcgtccaaaacctatgaggcaatcgcagaattcgttccagggctacttgatgatggtcccgcgatttgggaatcccgcatcgaaaaagaacgcggcatcgtgcaagccttcgtcgtggaaggccccgtcaacgcacgcactgaactggtgtcagtcaccccagtcgaagacgccgaacagagcatcctcgaagaaatgcacgggccactcccccgccaagcgcgctacgttctagccccctcaacaggcaaaacccaccagctgcgcatccacatgcgcgacttcgcagcccccatcctcggcgaccccctctaccccgtcctccacgcagtcgacgatgaggactacaccaccccaatgcacctcatcgcccgcacgctaaccttcgtggatcctcaaaccaacgaggaacgtacctttgtgagtaatcgacctacgggaagtttgtaggcctcgtagacatcacccag

SEQ ID NO: 584 - protein, 338 aa, Corynebacterium glutamicum
MIALKSMSNRVVQKPKMKAPLPIRDGLNPSRVRLPLDAAPIRAIDFVEYLISTQRHRNPADNAEALQARFDADLVVNHYGEPYAPDTMVQPDDDIWFYRMPAAERPIPYKIHVIHEDDDILVIDKPPYLATMPRGRHITETALVKMRVLTGNNDLTPAHRLDRLTSGVLVMVKKPELRGAYQTLFARREASKTYEAIAEFVPGLLDDGPAIWESRIEKERGIVQAFVVEGPVNARTELVSVTPVEDAEQSILEEMHGPLPRQARYVLAPSTGKTHQLRIHMRDFAAPILGDPLYPVLHAVDDEDYTTPMHLIARTLTFVDPQTNEERTFVSNRPTGSL

SEQ ID NO: 585 - DNA, 1281 bp, Corynebacterium glutamicum
  CDS (101)..(1258): RXC01711
tctcgtgagtttctccccggtagcaccttctatatcagcccccacgccgcgtcggagcaggtgggatagcatcggcaacgcggttgcatggccgttggccatgttgttgatggcgcatcgcttcttcgtgcttgcgattaacggcgcagtcaccgacgatttcacgacggtttatagtgctttacgacgtttcgttgaaggtattccggtctacaacgaggtctaccacttcgtcgatccgcactacctctataacccgggcgccaccctcctattggcaccattgggatatatcacccatttcacgttggctcggtggatgttcatcgcggtgaacctccttgccattgttttagcgttcgggctgctgaccagactctccggttgggcgctgcgcagcatggtgtggccgattgcgatcgccttggcgatgctgacagaaaccgtgcaaaacaccctcattttctccaacatcaacggcatcctgctgctcatgttggcgattttcctgtggtgcgtggtgcacaaaaaatcctggttgggcggactagtcattggtttggccattttgatcaaacccatgttcctgccacttctcttcctacctttggtgaaaaagcaatggggatcgctcatcctcggcattttaaccccagtgattttcaatgcagtggcctggttcttagttccgggagcatctgaatacgtcacccgcacgatgccctaccttggtgaaactcgagattttgccaacagctcactcccaggcttggccatctatttcggaatgcccacctggatggaaatcacctggttcctcatcttcggcgcaatggtcggcctcgcagtgctggcactcctgagattccgtaacaccgagccatacttctgggcagcaaccaccaccggtgtactcctgactggcgtattcttcctgtcctcactgggacagatgtactactccatgatgatcttccctatgatcttcaccctgctcggaagccgatccgtattccacaactgggttgcctgggtcgccgcctacttcttactatcccctgacactttcacctcccagcgactacccgatgtagcccgctggatggaatttttcagcgcgaccgttggttggggactattgatagtggttacatttgtctcggcgctaatctggtttattggtgatatccgagccaagggaactccgagctcacccattaccactgatccaacgcacgaccatcttgagaggacagcatgacagacttcaaactcatcagc

SEQ ID NO: 586 - protein, 386 aa, Corynebacterium glutamicum
MLLMAHRFFVLAINGAVTDDFTTVYSALRRFVEGIPVYNEVYHFVDPHYLYNPGATLLLAPLGYITHFTLARWMFIAVNLLAIVLAFGLLTRLSGWALRSMVWPIAIALAMLTETVQNTLIFSNINGILLLMLAIFLWCVVHKKSWLGGLVIGLAILIKPMFLPLLFLPLVKKQWGSLILGILTPVIFNAVAWFLVPGASEYVTRTMPYLGETRDFANSSLPGLAIYFGMPTWMEITWFLIFGAMVGLAVLALLRFRNTEPYFWAATTTGVLLTGVFFLSSLGQMYYSMMIFPMIFTLLGSRSVFHNWVAWVAAYFLLSPDTFTSQRLPDVARWMEFFSATVGWGLLIVVTFVSALIWFIGDIRAKGTPSSPITTDPTHDHLERTA

SEQ ID NO: 587 - DNA, 777 bp, Corynebacterium glutamicum
  CDS (101)..(754): RXC02380
gcagatttttgacgaagtcgcatcgtggattgaagctgcctaaaaactcgcgaggacgcatgctcagcaaggtggtgtgcgaacactatactgtccactcatgactacaacggtgaaacgccgcgctcgcattggcatcatgggtggcacatttgaccccattcataatggtcaccttgtggcgggctcagaggtagcggatcgattcgatcttgatctggtggtgtacgttcccaccggacagccatggcaaaaggcgaacaagaaagtcagcccagcggaagatcgttacctgatgacggtgatcgccactgcctctaatccacggtttatggtatcgcgggttgatattgatcggggaggggatacttacacgatcgataccctgcaagatttgagcaagcaatacccggacgcccagctgtacttcatcaccggtgccgatgcactggcacagatcgtgacgtggcgcgattgggagaaaaccttcgaacttgcccacttcgttggagtgactcgacccggttatgaattggatggaaacatcattccggaaatgcaccaagatcgagtctcattggtggatatccccgccatggctatttcctccacggactgcagagaacgctccagcgaagaacgccctgtttggtatcttgtccctgatggcgtggtgcaatacattgccaaacgccaactctatcgacctgaaggatccgataaggatatggatcccaagggccaaaaccaagcataaatctagtcaaaagtttcaac

SEQ ID NO: 588 - protein, 218 aa, Corynebacterium glutamicum
MTTTVKRRARIGIMGGTFDPIHNGHLVAGSEVADRFDLDLVVYVPTGQPWQKANKKVSPAEDRYLMTVIATASNPRFMVSRVDIDRGGDTYTIDTLQDLSKQYPDAQLYFITGADALAQIVTWRDWEKTFELAHFVGVTRPGYELDGNIIPEMHQDRVSLVDIPAMAISSTDCRERSSEERPVWYLVPDGVVQYIAKRQLYRPEGSDKDMDPKGQNQA

SEQ ID NO: 589 - DNA, 777 bp, Corynebacterium glutamicum; identical to SEQ ID NO: 587
  CDS (101)..(754): FRXA02380

SEQ ID NO: 590 - protein, 218 aa, Corynebacterium glutamicum; identical to SEQ ID NO: 588

SEQ ID NO: 591 - DNA, 594 bp, Corynebacterium glutamicum
  CDS (101)..(571): RXC02921
tggaaaactgggaagggttgacgttgcggaatctctccgcagcgtcggttcggaccctaaaaaagggtgaggaaccacatgagctgttttaaggaattttgtgtctgcacttgaagagtcgatccgcatcgcgaccatcgcggcgaaagcagcggatgaaaagaaggccgatgacatcgctgtcatcgatgtctctgacatgatcgcaatcaccgattgctttgttgttgcatctgctgacaatgagcgccaggtgggcgccattgttgaggagatcgaagatgagatgaccaaggctggtttcgagcctaagcgccgtgaaggcaaccgcgaaaaccgttgggttctccttgactacggattggttgttatccacgttcagcgacaggcagagcgcgagttctacggactggatcgtctgtaccgcgactgcccactcattgaaattgaaggacttgaaaccttcaagcgtgaatcctcctggtctgatgaggcggatatccgcaacatcgacagcattgatgaactcccacctttgccagctgaatacgagcctggctacgaggacgattaagaggtagtcctgtgactcgt

SEQ ID NO: 592 - protein, 157 aa, Corynebacterium glutamicum
VSALEESIRIATIAAKAADEKKADDIAVIDVSDMIAITDCFVVASADNERQVGAIVEEIEDEMTKAGFEPKRREGNRENRWVLLDYGLVVIHVQRQAEREFYGLDRLYRDCPLIEIEGLETFKRESSWSDEADIRNIDSIDELPPLPAEYEPGYEDD

SEQ ID NO: 593 - DNA, 3075 bp, Corynebacterium glutamicum; identical to SEQ ID NO: 507
  CDS (101)..(3052): RXC01434

SEQ ID NO: 594 - protein, 984 aa, Corynebacterium glutamicum; identical to SEQ ID NO: 508

SEQ ID NO: 595 - DNA, 915 bp, Corynebacterium glutamicum; identical to SEQ ID NO: 549
  CDS (101)..(892): RXA01807

SEQ ID NO: 596 - protein, 264 aa, Corynebacterium glutamicum; identical to SEQ ID NO: 550

SEQ ID NO: 597 - DNA, 1461 bp, Corynebacterium glutamicum
  CDS (101)..(1438): RXN02754
attatgaagccatcggagttggtgtggcctacaagggtgatcatgcgtggatagtggtggagttcactgtagctcccgctgattccgtagaatcaacagagtgaataccaatccgtctgaattctcctcaaaccgttcaacagctctccttactgataaatatgagctgaccatgcttcaagcagcgctcgctgatggttctgcagaacgcccctcaacgtttgaggtctttagccgccgcctccccaacgagcgccgatacggtgtcgtcgcaggaacagcacgagtgctgaaggcgattcgtgactttgtattcacagaggaacaactcgccgatcttgactttttagacgaccgtaccctggaatacctccgcaactaccgattcaccggccaagttgatggctaccgcgaaggcgaaatctacttcccgcagtcccctcttctgactgtgcgtggcacgtttgcagaatgcgtcatcctagaaactgtcattttgtccatcatgaatgcagattctgccgtcgcttccgccgctgcgcgcatggtcaccgcagctgatggtcgccccatcatcgaaatgggatccaggcgcacccacgaatactcggcagtcaccgcatcccgcgcagcatacctcgctggattctccaccacctccaacctcgaggcggcctaccgctacggaattccagcatccggaacctccgcccacgcatggactttgctgcacatcaacgatgacggcacccccaacgaagcagcagctttcaaagcacaggttgaatccctcggcgtggacaccaccttgctggtagatacttatgacatcacccaaggtgtggccaccgccattgaagttgcaggtccagaccttggtggcgtacgtatcgactccggcgacctaggtgtgcttgcccgaaaggtccgcaagcagctcgacgatctcaacgcccacaacaccaagattgtggtctcctccgacctggatgaattcgccatcgcgggtcttcgcggcgaaccagttgacgtctttggcgttggcacctccgttgtcacaggttctggcgcaccaaccgctggcctcgtgtacaagatcggggaagttgccggtcaccctgtggccaagcgttcccgaaacaaggaaagctacggtggtggcaagaaggctgtgcgcacccaccgcaagtccggtaccgcaatcgaagaaatcgtctacccattcaatgccgaagcaccagatactggaaagctcgacactttgagcctgaccatcccattgatgcgcgacggtgaaatcgttccaggtttgcctactttggaagattcccgagcgtatttggccaagcaattggtctctttaccatgggaaggccttgcactgtctcgcgatgagcctgttttgcacactcgtttcgtgggtttcccgccggccgcttagacaattcggtctcaccaaac

SEQ ID NO: 598 - protein, 446 aa, Corynebacterium glutamicum
VNTNPSEFSSNRSTALLTDKYELTMLQAALADGSAERPSTFEVFSRRLPNERRYGVVAGTARVLKAIRDFVFTEEQLADLDFLDDRTLEYLRNYRFTGQVDGYREGEIYFPQSPLLTVRGTFAECVILETVILSIMNADSAVASAAARMVTAADGRPIIEMGSRRTHEYSAVTASRAAYLAGFSTTSNLEAAYRYGIPASGTSAHAWTLLHINDDGTPNEAAAFKAQVESLGVDTTLLVDTYDITQGVATAIEVAGPDLGGVRIDSGDLGVLARKVRKQLDDLNAHNTKIVVSSDLDEFAIAGLRGEPVDVFGVGTSVVTGSGAPTAGLVYKIGEVAGHPVAKRSRNKESYGGGKKAVRTHRKSGTAIEEIVYPFNAEAPDTGKLDTLSLTIPLMRDGEIVPGLPTLEDSRAYLAKQLVSLPWEGLALSRDEPVLHTRFVGFPPAA

SEQ ID NO: 599 - DNA, 871 bp, Corynebacterium glutamicum
  CDS (101)..(871): FRXA02405
attatgaagccatcggagttggtgtggcctacaagggtgatcatgcgtggatagtggtggagttcactgtagctcccgctgattccgtagaatcaacagagtgaataccaatccgtctgaattctcctcaaaccgttcaacagctctccttactgataaatatgagctgaccatgcttcaagcagcgctcgctgatggttctgcagaacgcccctcaacgtttgaggtctttagccgccgcctccccaacgagcgccgatacggtgtcgtcgcaggaacagcacgagtgctgaaggcgattcgtgactttgtattcacagaggaacaactcgccgatcttgactttttagacgaccgtaccctggaatacctccgcaactaccgattcaccggccaagttgatggctaccgcgaaggcgaaatctacttcccgcagtcccctcttctgactgtgcgtggcacgtttgcagaatgcgtcatcctagaaactgtcattttgtccatcatgaatgcagattctgccgtcgcttccgccgctgcgcgcatggtcaccgcagctgatggtcgccccatcatcgaaatgggatccaggcgcacccacgaatactcggcagtcaccgcatcccgcgcagcatacctcgctggattctccaccacctccaacctcgaggcggcctaccgctacggaattccagcatccggaacctccgcccacgcatggactttgctgcacatcaacgatgacggcacccccaacgaagcagcagctttcaaagcacaggttgaatccctcggcgtggacaccaccttgctggtagatacttatgacatcacccaaggtgtggccaccgccattgaagttgcaggtcca

SEQ ID NO: 600 - protein, 257 aa, Corynebacterium glutamicum
VNTNPSEFSSNRSTALLTDKYELTMLQAALADGSAERPSTFEVFSRRLPNERRYGVVAGTARVLKAIRDFVFTEEQLADLDFLDDRTLEYLRNYRFTGQVDGYREGEIYFPQSPLLTVRGTFAECVILETVILSIMNADSAVASAAARMVTAADGRPIIEMGSRRTHEYSAVTASRAAYLAGFSTTSNLEAAYRYGIPASGTSAHAWTLLHINDDGTPNEAAAFKAQVESLGVDTTLLVDTYDITQGVATAIEVAGP

SEQ ID NO: 601 - DNA, 509 bp, Corynebacterium glutamicum
  CDS (1)..(486): FRXA02754
cccacaaacaccaagattgtggtctcctccgacctggatgaattcgccatcgcgggtcttcgcggcgaaccagttgacgtctttggcgttggcacctccgttgtcacaggttctggcgcaccaaccgctggcctcgtgtacaagatcggggaagttgccggtcaccctgtggccaagcgttcccgaaacaaggaaagctacggtggtggcaagaaggctgtgcgcacccaccgcaagtccggtaccgcaatcgaagaaatcgtctacccattcaatgccgaagcaccagatactggaaagctcgacactttgagcctgaccatcccattgatgcgcgacggtgaaatcgttccaggtttgcctactttggaagattcccgagcgtatttggccaagcaattggtctctttaccatgggaaggccttgcactgtctcgcgatgagcctgttttgcacactcgtttcgtgggtttcccgccggccgcttagacaattcggtctcaccaaac

SEQ ID NO: 602 - protein, 162 aa, Corynebacterium glutamicum
PTNTKIVVSSDLDEFAIAGLRGEPVDVFGVGTSVVTGSGAPTAGLVYKIGEVAGHPVAKRSRNKESYGGGKKAVRTHRKSGTAIEEIVYPFNAEAPDTGKLDTLSLTIPLMRDGEIVPGLPTLEDSRAYLAKQLVSLPWEGLALSRDEPVLHTRFVGFPPAA

SEQ ID NO: 603 - DNA, 960 bp, Corynebacterium glutamicum
  CDS (101)..(937): RXA02112
tgaatccgtggcggcaccggcgcgagtcgctttggaaaggatgctatctgttgttccagcagctcctgttactcctagctcctcgaaggatgcgtaatttatgactacccatattgaccgcatcgttggcgcagcgttatccgaggatgcgccatggggcgacattacctccgacacttttatcccaggatcggcgcagctgagcgccaaggttgttgcccgggagccaggtgtgttcagcgggcaggcgcttttagacgcctccttccggctcgtcgatcctaggataaacgcatcccttaaggtggctgatggtgacagctttgaaaccggggacatcctaggaacaattaccggcagtgctagaagcatcctccgttcagagcgcattgctctcaacttcattcagaggacgtccggcatcgctacattgacatcgtgctatgttgcagaggttaaaggcaccaaagcccgcattgttgatacccggaaaaccacacccggcctgcgcatcattgaacgccaagctgtccgtgacggtggcggatttaatcaccgagccaccttgtccgatgctgtcatggtgaaagataaccatctcgcagccatcgcatcccaggggctcagcatcactgaagcgctgtcgaatatgaaagctaaactcccccacaccacccatgtggaagtcgaagttgatcatatagagcagatcgaaccagttcttgctgctggtgtggacaccatcatgttggataatttcaccattgatcagctcatcgaaggcgttgatctcattggtggacgtgcactggtggaagcatctggcggagtcaacctcaacaccgcgggaaagattgcatcaaccggtgtcgacgtcatttccgttggagcgcttacccattctgtgcatgcacttgacctaggactcgatattttctaatgctctaccttgataatgca

SEQ ID NO: 604 - protein, 279 aa, Corynebacterium glutamicum
MTTHIDRIVGAALSEDAPWGDITSDTFIPGSAQLSAKVVAREPGVFSGQALLDASFRLVDPRINASLKVADGDSFETGDILGTITGSARSILRSERIALNFIQRTSGIATLTSCYVAEVKGTKARIVDTRKTTPGLRIIERQAVRDGGGFNHRATLSDAVMVKDNHLAAIASQGLSITEALSNMKAKLPHTTHVEVEVDHIEQIEPVLAAGVDTIMLDNFTIDQLIEGVDLIGGRALVEASGGVNLNTAGKIASTGVDVISVGALTHSVHALDLGLDIF

SEQ ID NO: 605 - DNA, 1407 bp, Corynebacterium glutamicum
  CDS (101)..(1384): RXA02111
gcttgcgggaacaccgcaccgcccacccaaactgttcagattccaaagataaattctgacgctcattccagcccaccgtttagaagaaaagaccccaatcatgaccacctcaatcaccccatctgtcaaccttgcattgaaaaatgccaatagctgcaacagtgaactcaaagacggaccctggttcctcgaccagcccggaatgccggatgtctacggccccggcgcgtcacaaaacgatccgatccctgcgcatgctccgcgccagcaggttctccccgaggagtaccagcgcgcaagtgatgacgaactgcatcgtaggatccgggaagcgaaagacaccctgggtgacaaagtggttatcctaggacacttctaccagcgcgatgaagttatccaacacgcagattttgttggtgactctttccaacttgcccgcgctgccaaaacccgacccgaggcggaagcgattgtgttctgcggtgtgcacttcatggctgaaaccgctgatctgttatccacggatgaacaatcagtgatcctccccaaccttgccgcaggttgctccatggcagacatggctgaccttgattccgtcgaagactgctgggagcaactcacctcaatttatggcgatgacaccctgatccctgtgacctacatgaattcctctgcagcgctcaaaggtttcgtgggtgagcacggcggaattgtatgcacctcctcaaatgcacgttccgtattggagtgggcgtttgaacgcggccaacgagtcctgttcttccccgatcagcacttgggtcgaaacaccgcgaaagccatgggcattgggatcgatcaaatgcccctgtggaatcccaacaaaccactgggtggcaacaccgtttccgagctagaaaacgcaaaggtactgctctggcatggtttctgctctgtacacaagcgctttactgtcgagcagatcaacaaagcccgcgccgagtaccccgacgttcacgtcatcgtgcaccctgaatcccccatgccagttgttgacgccgccgactcatccggatccactgacttcattgtgaaagccattcaagcagcaccggcaggatctacctttgcgatcggcaccgaaatcaacttggttcagcgcctggcagcccagtacccgcagcacaccatcttctgcctcgaccctgtcatctgcccatgctccaccatgtatcgcattcaccctggttacctggcctgggcacttgaggagttggtggctggaaacgtgattaaccagatttctgtctctgaatccgtggcggcaccggcgcgagtcgctttggaaaggatgctatctgttgttccagcagctcctgttactcctagctcctcgaaggatgcgtaatttatgactacccatattga

SEQ ID NO: 606 - protein, 428 aa, Corynebacterium glutamicum
MTTSITPSVNLALKNANSCNSELKDGPWFLDQPGMPDVYGPGASQNDPIPAHAPRQQVLPEEYQRASDDELHRRIREAKDTLGDKVVILGHFYQRDEVIQHADFVGDSFQLARAAKTRPEAEAIVFCGVHFMAETADLLSTDEQSVILPNLAAGCSMADMADLDSVEDCWEQLTSIYGDDTLIPVTYMNSSAALKGFVGEHGGIVCTSSNARSVLEWAFERGQRVLFFPDQHLGRNTAKAMGIGIDQMPLWNPNKPLGGNTVSELENAKVLLWHGFCSVHKRFTVEQINKARAEYPDVHVIVHPESPMPVVDAADSSGSTDFIVKAIQAAPAGSTFAIGTEINLVQRLAAQYPQHTIFCLDPVICPCSTMYRIHPGYLAWALEELVAGNVINQISVSESVAAPARVALERMLSVVPAAPVTPSSSKDA

SEQ ID NO: 607 - DNA, 954 bp, Corynebacterium glutamicum
  CDS (101)..(931): RXA01073
taaccgactccagcactaaactccaaacccttggcccgcaccgccaaagtttagcgcgccccaagacaccaccgcgccatgtttgcctaggattaggtacatgacaaacactcaaaccgagatcattaatgaactaaaggtgagcccagcaatcgacgtggccaaggaagttgaattccgtgtgcagttcctcgtcgattacctgcgggcttcccatacaaaaggctttgttcttggtatttcaggtggccaggattccactcttgcgggacgactcacgcagctggcagtagagcgcattcgtgcggaagaaaacagcacggattatgtcttctacgcagttcgcctcccctacgcgatccaggcagatgaggacgatgcgcaagttgcattggaattcatcgcacctgacaagagcgtgaccgtcaacgttaaagacgcaacggacgccaccgaagcaactgttgcagctgctttggaacttcctgagctgaccgacttcaatcggggcaatattaaagctcgccaacgcatggttgcccagtacgcaatcgcaggccagttgggcttgctggttattggcactgatcacgcggctgaaaacgtcacggggttcttcaccaaattcggtgatggcgcagctgacctgcttcctttggcaggtttgagcaagcgtcaaggagctgccattctggagcacctgggtgcaccttcaagcacgtggaccaaggttcctaccgctgatttggaagaggatcgcccagcgttgccagatgaggaagcacttggtgtgtcgtatgcggacatcgataattacctggaaaacaagcccgatgtcagtgaaaaagcccagcagcgcattgagcacctgtggaaggtgggccagcacaagcgccacctccctgctaccccgcaggaaaattggtggcgttaatccaacagtttgagtgtcgc

SEQ ID NO: 608 - protein, 277 aa, Corynebacterium glutamicum
MTNTQTEIINELKVSPAIDVAKEVEFRVQFLVDYLRASHTKGFVLGISGGQDSTLAGRLTQLAVERIRAEENSTDYVFYAVRLPYAIQADEDDAQVALEFIAPDKSVTVNVKDATDATEATVAAALELPELTDFNRGNIKARQRMVAQYAIAGQLGLLVIGTDHAAENVTGFFTKFGDGAADLLPLAGLSKRQGAAILEHLGAPSSTWTKVPTADLEEDRPALPDEEALGVSYADIDNYLENKPDVSEKAQQRIEHLWKVGQHKRHLPATPQENWWR

SEQ ID NO: 609 - DNA, 1461 bp, Corynebacterium glutamicum; identical to SEQ ID NO: 597
  CDS (101)..(1438): RXN02754

SEQ ID NO: 610 - protein, 446 aa, Corynebacterium glutamicum; identical to SEQ ID NO: 598

SEQ ID NO: 611 - DNA, 531 bp, Corynebacterium glutamicum; identical to SEQ ID NO: 137
  CDS (101)..(508): RXA02299

SEQ ID NO: 612 - protein, 136 aa, Corynebacterium glutamicum; identical to SEQ ID NO: 138

SEQ ID NO: 613 - DNA, 960 bp, Corynebacterium glutamicum
  CDS (101)..(937): RXA01928
gcgagtacgccaccttgggcgattccttgcacgacgccgcgcaggcctacatcgccgatatccacgcgggtaccttcccaggcgaagcggagtccttttaatgcaggtagcaaccacaaagcaggcgcttatcgacgccctcctccaccacaaatccgtcgggctcgtccccaccatgggtgcgctacacagcggacacgcctcgttggttaaagcagcacgcgctgaaaacgacactgttgtagccagtatttttgtcaatcccctgcagtttgaagcactcggtgattgcgatgattaccgcaactatccccgccaactcgacgccgatttagcactgcttgaagaggcaggtgtggatattgtgttcgcacccgatgtggaggaaatgtaccccggtggcttgccactagtgtgggcgcgcaccggttccatcggaacaaaattggagggtgccagcaggcctggccatttcgatggtgtggctaccgtggtggcgaagctgttcaatttggtgcgccctgatcgtgcatattttggacaaaaagatgctcagcaggttgcggtgattcggcgattggttgccgatctagacattcccgtggagattcgtcccgttccgattattcgtggcgccgatggcttagccgaatccagccgcaatcaacgtctttctgcggatcagcgagcgcaagctctggtgctgccgcaggtgttgagtgggttgcagcgtcgaaaagcagctggtgaagcgctagatatccaaggtgcgcgcgacaccttggccagcgccgacggcgtgcgcttggatcacctggaaattgtcgatccagccaccctcgaaccattagaaatcgacggcctgctcacccaaccagcgttggtggtcggcgcgattttcgtggggccggtgcggttgatcgacaatatcgagctctagtaccaaccctgcgttgcagc

SEQ ID NO: 614 - protein, 279 aa, Corynebacterium glutamicum
MQVATTKQALIDALLHHKSVGLVPTMGALHSGHASLVKAARAENDTVVASIFVNPLQFEALGDCDDYRNYPRQLDADLALLEEAGVDIVFAPDVEEMYPGGLPLVWARTGSIGTKLEGASRPGHFDGVATVVAKLFNLVRPDRAYFGQKDAQQVAVIRRLVADLDIPVEIRPVPIIRGADGLAESSRNQRLSADQRAQALVLPQVLSGLQRRKAAGEALDIQGARDTLASADGVRLDHLEIVDPATLEPLEIDGLLTQPALVVGAIFVGPVRLIDNIEL

SEQ ID NO: 615 - DNA, 936 bp, Corynebacterium glutamicum; identical to SEQ ID NO: 279
  CDS (101)..(913): RXN01929

SEQ ID NO: 616 - protein, 271 aa, Corynebacterium glutamicum; identical to SEQ ID NO: 280

SEQ ID NO: 617 - DNA, 930 bp, Corynebacterium glutamicum; identical to SEQ ID NO: 281
  CDS (101)..(907): FRXA01929

SEQ ID NO: 618 - protein, 269 aa, Corynebacterium glutamicum; identical to SEQ ID NO: 282

SEQ ID NO: 619 - DNA, 921 bp, Corynebacterium glutamicum
  CDS (101)..(898): RXA01521
accccggcaggcaacgccttttccgggatttggcgcgcaggcaggcagagatttcccgcgcgcaagatattgagctgtgggcaattcagaaggaggaccgttgagtttcacgcatggtcagggcagagtttttgataccgtcgagcagatccgcatgttcggcagcgccctgcgcaaaaccggcaaaccagtggtgctcgtacccttgggaaatggcctccacgcaggccatattgcgctcatccgcgcagcaaaacgcatccccggtgcggtggtcgtcgtcgcctatgccggcccggaatcggatcacgcacgtttaagggaagagcttatcgacgcgatcttcccgttcaatcccgaaacgctatggcctcacggcatccgggtggaagttacaggtggcccaacacttaccccacaaggtgcggaagtaaccaaggtgctggggctgttgggaatcaccggagcaactgatgtggtgctcggtgaaaaggactatgagctggtggttctagtccagcgcgcccttaatgatctgcatattccagtaaaactgcattctgttccaaccgtgcgcatgccagatggactagccatttccctgcgtaatatttcagtgcccgaagactcccgcgaaacggcattgagcctggcagcagccctcaccgccggtgcgcattcggcagaacacggcgaggcagtggttaaagaaacagtcacgcaagtgctcaaagccgcaggcgtgacccccgattatgtagaaatccgtggcctggatcttggaccagcccccgaaatcggagacgcccgactcttcgcagccatcacgcttggcgatgtccaactccacgacaacgtcggcctaccccttggaatcggcttcaaaaacatcgaaggctgatcccggtttacccagttcgc

SEQ ID NO: 620 - protein, 266 aa, Corynebacterium glutamicum
LSFTHGQGRVFDTVEQIRMFGSALRKTGKPVVLVPLGNGLHAGHIALIRAAKRIPGAVVVVAYAGPESDHARLREELIDAIFPFNPETLWPHGIRVEVTGGPTLTPQGAEVTKVLGLLGITGATDVVLGEKDYELVVLVQRALNDLHIPVKLHSVPTVRMPDGLAISLRNISVPEDSRETALSLAAALTAGAHSAEHGEAVVKETVTQVLKAAGVTPDYVEIRGLDLGPAPEIGDARLFAAITLGDVQLHDNVGLPLGIGFKNIEG

SEQ ID NO: 621 - DNA, 1137 bp, Corynebacterium glutamicum; identical to SEQ ID NO: 285
  CDS (101)..(1114): RXS01145

SEQ ID NO: 622 - protein, 338 aa, Corynebacterium glutamicum; identical to SEQ ID NO: 286

SEQ ID NO: 623 - DNA, 556 bp, Corynebacterium glutamicum; identical to SEQ ID NO: 287
  CDS (101)..(556): FRXA01145

SEQ ID NO: 624 - protein, 152 aa, Corynebacterium glutamicum; identical to SEQ ID NO: 288

SEQ ID NO: 625 - DNA, 1389 bp, Corynebacterium glutamicum
  CDS (101)..(1366): RXA02239
ctatgcacagcggaggtcgagggagagcgtggggtggcgtcgaaaagcatcttgtagagtgtgtgggaacccagccagcctcttactttgaaggattgttgtgcccatgactcatgtttcaagcccctccgcaccccgcaacgtggttgttggtgttgccggcggaatcgcagcgtacaaggcgtgtcacatcgtgcgcgcgtttaaagaagcgggcgataatgtgcgggtggttcctacggaatccgcgttgaagtttgtggggaaggcgacgtttgaagcgttgtctggcaatccggtgtctacaacggtgtttgatgcggtggattcggtgcagcatgtgaaagttggccaggaagctgatttgatcgtgattgcgccggcgacagccgatttgatggcgcgtgtggtggcaggtctcggtgacgatctgttggcggcgacgctgctggtggcaacgtgccccgtggttattgcgccggccatgcatacggagatgtggtttaatccggctaccgtagccaatgtggcaacgctgaggcagcgggggattaccgtgattgagcctgcgcatggtcgactcaccggtaaagatacaggccctggccggctgccggatccagagcagattgttgatttagccaatgcggtgcacgccggggcgaggttgcctcaggatttggcgggcaagaaagtgctgatcactgctggtggcacgcatgagcatattgatcctgtgcgctttattggcaatagttcctcgggccgtcaaggttttgcgttgggtgaaatcgcagcacagcgaggtgctcatgtcagcatcgtggcgggaaatgctgcggagctgcccactccggcaggcgcagagatcgtgccggtggtgtccacacaagacatgtttgatgcagtccaggaacgagctggccaatctgatttcatcgtcatggcggcagcggtagctgatttcacgcccgcatcgcaggcgacatcgaagttgaagaagggctcagattctgatgaagacgcattgagcaccatctcgttggtggaaaacccggatattttggctaccacggtgaagcgtcgtgaagcaggagagctggacagtaatcctgtcatcgtgggttttgctgcggaaactggagacgagcacaccaccgccttggagtatgcgcgcaagaaactgcagaagaagggctgcgacctcctcatgtgtaatgaggtgggcatgggcaaagtgtttgggcaaaagcacaatgagggctggattttggatgctcacggtggggtagtcgatgtggagcacggcagcaaaatcgaggttgctgcgcaaatttgggacgcggcactggcgtatcgcgaagtctagaaaaatccagctagaccact

SEQ ID NO: 626 - protein, 422 aa, Corynebacterium glutamicum
VPMTHVSSPSAPRNVVVGVAGGIAAYKACHIVRAFKEAGDNVRVVPTESALKFVGKATFEALSGNPVSTTVFDAVDSVQHVKVGQEADLIVIAPATADLMARVVAGLGDDLLAATLLVATCPVVIAPAMHTEMWFNPATVANVATLRQRGITVIEPAHGRLTGKDTGPGRLPDPEQIVDLANAVHAGARLPQDLAGKKVLITAGGTHEHIDPVRFIGNSSSGRQGFALGEIAAQRGAHVSIVAGNAAELPTPAGAEIVPVVSTQDMFDAVQERAGQSDFIVMAAAVADFTPASQATSKLKKGSDSDEDALSTISLVENPDILATTVKRREAGELDSNPVIVGFAAETGDEHTTALEYARKKLQKKGCDLLMCNEVGMGKVFGQKHNEGWILDAHGGVVDVEHGSKIEVAAQIWDAALAYREV

SEQ ID NO: 627 - DNA, 1092 bp, Corynebacterium glutamicum
  CDS (101)..(1069): RXA00581
gcatgagtttactcacgtgcccacgtcttttagccacccattgaagtgaaaaaataaccccgatcacactagtggagtagctaaggtgcacaatggattcatggcagagcaaaacgctgcaagcacaactggtgtgaaaccttccccacgcacaccagatttcagcccctaccttgatttcgaccgcgcacaatggcgcgagctgagaaactcaatgcctcaggtgctgacccaaaaagaagtcattgaacttcgaggcatcggagaaaacattgacctcgctgaagtggcagaagtctaccttccgctgtcccgtctgattcacctccaggtagcggcccgacagcaacttactgcagccaccgaaaccttcctcggaacttccccctctatctctgtgccgtttgtcattggtgtcgcgggatccgtcgccgtcggtaaatcaaccaccgcccgactcctccaagttctgcttcagcgctggaattcccacccccgcgtggacctcgtcaccaccgacggattcctctatcccggcgcggaactaatccgccgcggattaatgtcccgaaaaggattccccgaaagctacgaccaacgtgcactcctccgctttgtcaccgacgtaaaatccggaaaactcgaagtcaacgcacctgtctactcccacaccgcgtacgaccgagttccaggcgaattcaccacagtccgccaacccgacattttgatcgtcgaaggcttaaacgtcctccaaactggcccaacattgatggtcagtgaccttttcgacttcagcgtctacgtagatgcccgcaccgaagatatcgaaaaatggtacatcgaccgcttcctcaaactccgcgacactgcattccgtcgccccggtgcccacttctcccattacgccgacatggctgatccagagtccatcgccgtcgctcgagaactgtggcaatcgatcaacctgcccaacttggtggagaatattcttcccacccgagttcgcgcgtcgttggtactgaaaaaaggtagcgatcacttggtggaacgggtgaggatgcgcaagatctaggggttcttgctggttttgag

SEQ ID NO: 628 - protein, 323 aa, Corynebacterium glutamicum
MAEQNAASTTGVKPSPRTPDFSPYLDFDRAQWRELRNSMPQVLTQKEVIELRGIGENIDLAEVAEVYLPLSRLIHLQVAARQQLTAATETFLGTSPSISVPFVIGVAGSVAVGKSTTARLLQVLLQRWNSHPRVDLVTTDGFLYPGAELIRRGLMSRKGFPESYDQRALLRFVTDVKSGKLEVNAPVYSHTAYDRVPGEFTTVRQPDILIVEGLNVLQTGPTLMVSDLFDFSVYVDARTEDIEKWYIDRFLKLRDTAFRRPGAHFSHYADMADPESIAVARELWQSINLPNLVENILPTRVRASLVLKKGSDHLVERVRMRKI

SEQ ID NO: 629 - DNA, 1023 bp, Corynebacterium glutamicum; identical to SEQ ID NO: 535
  CDS (101)..(1000): RXS00838

SEQ ID NO: 630 - protein, 300 aa, Corynebacterium glutamicum; identical to SEQ ID NO: 536

SEQ ID NO: 631 - DNA, 408 bp, Corynebacterium glutamicum; identical to SEQ ID NO: 237
  CDS (101)..(385): RXC02238

SEQ ID NO: 632 - protein, 95 aa, Corynebacterium glutamicum; identical to SEQ ID NO: 238

SEQ ID NO: 633 - DNA, 606 bp, Corynebacterium glutamicum
  CDS (101)..(583): RXN03058
acgagcttccgctctgcacaagccgctagaagccccgcatagccctaatgtagagctcatgcccatttggaatcacaacaccgcatatcggccatggctggtgtcaaagctcaaaggctcaagatcgcttctcgacgtcggctccggcgatcactccttcgccgacctggccggccgccaggtcgcgcatgtcgatgtcgtggatcctcttattaatacaacctttgaagaattccagccgacccaaagctacgatgccatcacgttcatcgcgtccctccatcacatgaacgcggaagaaggacttaacaaagcagtccgaatcctcaatcctggcggcaagctcctcatcgtaggcctcgccaaaaacaaaaccgcctccgactggatcatctccggactacaagcttttctctcccgaccaatcagcctcatcaatagggaacaacaaatctaccccttccctaccaaagaaccctcagagagtctccacgaaatacgacaactcaccaagcagctcctccctcaccgccgtattcgccgtggaatccacttccgatacctcctcgagtggacaaagccttaaacagccctataaaccaaaaa

SEQ ID NO: 634 - protein, 161 aa, Corynebacterium glutamicum
VSKLKGSRSLLDVGSGDHSFADLAGRQVAHVDVVDPLINTTFEEFQPTQSYDAITFIASLHHMNAEEGLNKAVRILNPGGKLLIVGLAKNKTASDWIISGLQAFLSRPISLINREQQIYPFPTKEPSESLHEIRQLTKQLLPHRRIRRGIHFRYLLEWTKP

SEQ ID NO: 635 - DNA, 606 bp, Corynebacterium glutamicum; identical to SEQ ID NO: 633
  CDS (101)..(583): FRXA02903

SEQ ID NO: 636 - protein, 161 aa, Corynebacterium glutamicum; identical to SEQ ID NO: 634

SEQ ID NO: 637 - DNA, 783 bp, Corynebacterium glutamicum
  CDS (101)..(760): RXA00166
ggcgtttagcgatcttcaacatcgagcaaccagcgccagcgcttttacccaaggcagcacgacttatcacgatgtccgacctggatatccggctgaggccgtggagttagcccgtgggtttggccgagtcctggatgtcggtgcaggtaccggaaaactaaccagtgagctaacagctgatcaggtcctagcccttgatccaagcatggacatgttgcgggtgtttcgctccgcgcttccggcggttccctgctggcaagcgacagcagaacacacaggaatacgtgacaacgcggttgatctgattacgtgcgcacaaacgtggcattgggttgacgtgacggctgcctcagcggaatttgatcgggtgattgcacctgagggtgcagtcctgctcgtgtggaataacctggacacctccatcgcgtgggtacaccgactcagtcgcattatgcatgccggcgatgtactcaagccgggattcaccccagaaaccgcagctccctggataattgatcgagaaattcgcaccacgtggaatcagcacctcacccctgaagaaatcatccagctcgctcacacgaggtcctactggttaaacgcgtcagagaaaatcaaagagcgtgttgatcagaaccttcagtggtatctctacgagcatttgggtttcagtcccgacaatccagtggaacttccctatcgctgtgatgcatttttactttcacgttccggtaccctggcaggcagatcttccaatctttaggagccctcgccatgtacctg

SEQ ID NO: 638 - protein, 220 aa, Corynebacterium glutamicum
VELARGFGRVLDVGAGTGKLTSELTADQVLALDPSMDMLRVFRSALPAVPCWQATAEHTGIRDNAVDLITCAQTWHWVDVTAASAEFDRVIAPEGAVLLVWNNLDTSIAWVHRLSRIMHAGDVLKPGFTPETAAPWIIDREIRTTWNQHLTPEEIIQLAHTRSYWLNASEKIKERVDQNLQWYLYEHLGFSPDNPVELPYRCDAFLLSRSGTLAGRSSNL

SEQ ID NO: 639 - DNA, 1392 bp, Corynebacterium glutamicum
  CDS (101)..(1369): RXA00633
aaagctgcggtaattaaaaacacttagcgccaaaaattgaacactgttcaattaacctattacactgcagatatacatccaaaccaagtgacggaggaaaatggaaaaccccagcttgcgcgagcttgatcaccgaaacatctggcacccgtatgccgcgccgggcgtgcgcaatagactcgtcaccaaaaccgatggagtgtttttgacgctggaagatggcagcaccgtgattgacgcgatgagctcctggtggtcggcaattcatggacacggacacccccgactgaaagctgccgcccaaaaacaaatcgacaccatgagtcacgtcatgtttggcggactaacccacgagcccgccattaagctcacccacaaactcctcaatctcactggaaattcctttgaccacgtcttttattccgattcgggctcggtctcagtggaggtcgccatcaaaatggcactgcaggcctccaaaggacaaggccacccggaacggacaaaactcctcacctggcggtccggctaccacggagacacattcaccgcgatgagcgtgtgcgacccagaaaatggcatgcatagcctctggaaaggcacactccccgagcagattttcgcccccgccccaccagttcgggggtcatcgccgcaggcgatttccgagtacctgcgcagcatggaattgcttatcgacgaggcggtctccgcaatcatcatcgaaccgatcgtccaaggcgctggaggcatgcgctttcacgatgtcgcactcattgaaggagtcgccacactgtgcaagaagcacgatcgtttcttgatcgtcgatgaaattgccactggtttcggccgcaccggtgaactatttgccacgttaagcaatggcctacaaccagacatcatgtgtgtgggcaaggccctcaccggtggattcatgtccttcgccgctactttatgcacggacaaggtggctcaattaatcagcaccccaaatggcggaggtgcgctgatgcacggccccacttttatggctaatcctctggcctgtgcggtttcgcatgcttcattagaaatcattgagaccggcatgtggcagaaacaggtaaaaagaatcgaagccgaacttatcgcaggcctttccccacttcaacaccttccaggggttgccgatgtccgggttctcggcgcgattggtgtcatcgaaatggaacaaaatgtcaatgtcgaagaagctactcaggctgcattagatcacggtgtgtggatccgcccctttggacgcttgctctatgtcatgcctccatatatcaccacgtcagagcagtgcgcacagatctgcactgcgcttcatgctgcagttaaagggaaataaaccatgccatttttatttgt

SEQ ID NO: 640 - protein, 423 aa, Corynebacterium glutamicum
MENPSLRELDHRNIWHPYAAPGVRNRLVTKTDGVFLTLEDGSTVIDAMSSWWSAIHGHGHPRLKAAAQKQIDTMSHVMFGGLTHEPAIKLTHKLLNLTGNSFDHVFYSDSGSVSVEVAIKMALQASKGQGHPERTKLLTWRSGYHGDTFTAMSVCDPENGMHSLWKGTLPEQIFAPAPPVRGSSPQAISEYLRSMELLIDEAVSAIIIEPIVQGAGGMRFHDVALIEGVATLCKKHDRFLIVDEIATGFGRTGELFATLSNGLQPDIMCVGKALTGGFMSFAATLCTDKVAQLISTPNGGGALMHGPTFMANPLACAVSHASLEIIETGMWQKQVKRIEAELIAGLSPLQHLPGVADVRVLGAIGVIEMEQNVNVEEATQAALDHGVWIRPFGRLLYVMPPYITTSEQCAQICTALHAAVKGK

SEQ ID NO: 641 - DNA, 795 bp, Corynebacterium glutamicum
  CDS (101)..(772): RXA00632
tggacgcttgctctatgtcatgcctccatatatcaccacgtcagagcagtgcgcacagatctgcactgcgcttcatgctgcagttaaagggaaataaaccatgccatttttatttgtcagcggtaccggaactggggttgggaaaaccttctccacagccgttttggttcgatacttagccgatcaaggacacgatgttctgcccgtaaagctagtccaaaccggtgaacttccaggcgagggagacatctttaacattgaacgcttgactggaattgctggagaggaatttgctcgtttcaaagaccctcttgcgccaaatctggcagcccgacgagagggggtcgagccaatacagtttgatcagattatctcgtggcttcgtggttttgacgacccagatcgcatcattgtggtggagggcgctggtggcctgctggtcagattaggggaagatttcaccctggcagatgttgcctccgctttgaatgcacccttagtgattgtgacaagcaccggattgggaagcctcaacgctgctgaattaagcgttgaggcagcaaaccgccgaggactcacagtgttgggagtcctcggcggttcgatccctcaaaatcctgatctagctacgatgcttaatctcgaagaatttgagagagtcaccggcgtgcccttttggggagctttgccggaagggttgtcacgggtggaggggttcgtcgaaaagcaatcttttccggcccttgatgcctttaagaaaccgccggcaaggtgatcgtgaacaccgtgccttcg

SEQ ID NO: 642 - protein, 224 aa, Corynebacterium glutamicum
MPFLFVSGTGTGVGKTFSTAVLVRYLADQGHDVLPVKLVQTGELPGEGDIFNIERLTGIAGEEFARFKDPLAPNLAARREGVEPIQFDQIISWLRGFDDPDRIIVVEGAGGLLVRLGEDFTLADVASALNAPLVIVTSTGLGSLNAAELSVEAANRRGLTVLGVLGGSIPQNPDLATMLNLEEFERVTGVPFWGALPEGLSRVEGFVEKQSFPALDAFKKPPAR

SEQ ID NO: 643 - DNA, 1125 bp, Corynebacterium glutamicum
  CDS (101)..(1102): RXA00295
gtttaaggcacgtgtcattttgcatgcgcgtgcccaattcttcttaagtgtgctcaatttttaagcgcgcagttattgacaaccagcctctaggagatccatgaccatccccggcaccatccttgacaccgcccgcacccaagttctggaacagggaattggccttaatcagcagcagttgatggaggttctcaccttgcctgaagagcaaatcccagacttgatggaattagcccaccaggttcggttgaagtggtgtggggaagaaatcgaggtcgagggcattatttccctcaaaactggcggttgccctgaagattgtcatttctgctcacagtctgggttgtttgaatcgccggtgcgttcggtgtggctggatattccgaatctggttgaagccgctaaacagaccgcaaaaactggcgctaccgaattctgtatcgtcgccgcagtcaaggggcctgatgagaggctcatgacccagctggaggaagcagtcctcgcgattcactctgaagttgaaattgaagtcgcagcatcgatcggaacgttaaataaggaacaggtggatcgcctcgctgctgccggcgtgcaccgctacaaccataatttggaaactgcgcgttcctatttccctgaagttgtcaccactcatacatgggaagagcgccgcgaaactttgcgcctggtggcagaagctggaatggaagtctgttccggcggaatcttaggaatgggcgaaactttagagcagcgcgccgagtttgccgtgcagctggcggagcttgatccgcacgaagtccccatgaacttccttgatcctcgcccgggcaccccatttgccgatagggaattgatggacagccgtgacgctctgcgctctattggtgcgttccgccttgcgatgcctcacaccatgcttcgttttgctggcggtcgcgagctgactttgggcgacaagggttccgagcaagccctcctgggaggcatcaatgcgatgatcgtcggaaactacctgactacgctcggccgcccaatggaagatgacctcgacatgatggatcgtctccagctgcccatcaaagtccttaataaggtcatctaagaagcacgcgcatgaacgac

SEQ ID NO: 644 - protein, 334 aa, Corynebacterium glutamicum
MTIPGTILDTARTQVLEQGIGLNQQQLMEVLTLPEEQIPDLMELAHQVRLKWCGEEIEVEGIISLKTGGCPEDCHFCSQSGLFESPVRSVWLDIPNLVEAAKQTAKTGATEFCIVAAVKGPDERLMTQLEEAVLAIHSEVEIEVAASIGTLNKEQVDRLAAAGVHRYNHNLETARSYFPEVVTTHTWEERRETLRLVAEAGMEVCSGGILGMGETLEQRAEFAVQLAELDPHEVPMNFLDPRPGTPFADRELMDSRDALRSIGAFRLAMPHTMLRFAGGRELTLGDKGSEQALLGGINAMIVGNYLTTLGRPMEDDLDMMDRLQLPIKVLNKVI

SEQ ID NO: 645 - DNA, 1212 bp, Corynebacterium glutamicum
  CDS (101)..(1189): RXA00223
gcgacctctttgacatcgcccctgcgctcatcgaagagatcaacaagcgcaagtaggagttttgaacactttttatctggaccatgcagccaccacaccaatgcgtgaggtggccgcagctgcgtggatggaaaacgcgcaggcattgaatcccgcgagtcagtacggttcggggcgtaaggcgcgcagcgttgcggattcggctcgtgaagaaattgcttctttgctgggctgtgaacctatcgaggttgtgtttaccgcgtccggcacggaggcagataacctcgctgtgcaggggttattccacgcatcgcctctcaatcggattatttctacgccgatcgagcaccccgggattctggaaaccgtcaaggctctagaacttggcggggcagaggcggagctcatgccgatcggtccagatggacgagtgtcttccttcgaagcgctggacaagcctgccgcggttgccactatgatgtgggcgaacaatgagaccggcgcgattcagccggtttctgagttcatcgccgccgcgcaggcgtccggcacgccaacacacatcgatgcggttcaggtcgttggccatctgccggtcaattttgatgagctcggcgccaccactttggctgcctccgcgcacaaattcggtggaccacgtggcgtcggcctgctgttggtgaggcgctcaccagcaccttcagccgtattgcacggaggtggtcaggagcgcggcatccgtccaggcacccttgatgtcgccggcgcagctgccaccgcagccgcattacgcgaagcagtggccgagcttgacggcgaagccacccgcctgcgcggacttaaaaagatgcttctcgacgccatcctccacaccatccccaacgtactggtccacaccaccgaaccatccctgccaggacacctgcatctctccttcccaggagcagaaggcgatagtttgatcatgctgctcgactccttgcggatcgaagcctccacaggttcggcctgctccaacggtgtaaaccgtgccagccacgtccttttggccatgggaatttccgaaaccgacgcccgtggtgccatccgattcaccctcggaagaaccaccactgaagaatccatcaaggcagtgatcgccgtgatcgaagacgtagtgaccagggctcgtactgcgggaatggctttttagcgaccgtaaatcgcatagtg

SEQ ID NO: 646 - protein, 363 aa, Corynebacterium glutamicum
MREVAAAAWMENAQALNPASQYGSGRKARSVADSAREEIASLLGCEPIEVVFTASGTEADNLAVQGLFHASPLNRIISTPIEHPGILETVKALELGGAEAELMPIGPDGRVSSFEALDKPAAVATMMWANNETGAIQPVSEFIAAAQASGTPTHIDAVQVVGHLPVNFDELGATTLAASAHKFGGPRGVGLLLVRRSPAPSAVLHGGGQERGIRPGTLDVAGAAATAAALREAVAELDGEATRLRGLKKMLLDAILHTIPNVLVHTTEPSLPGHLHLSFPGAEGDSLIMLLDSLRIEASTGSACSNGVNRASHVLLAMGISETDARGAIRFTLGRTTTEESIKAVIAVIEDVVTRARTAGMAF

SEQ ID NO: 647 - DNA, 1197 bp, Corynebacterium glutamicum
  CDS (101)..(1174): RXN00262
acaccgcgggaaagattgcatcaaccggtgtcgacgtcatttccgttggagcgcttacccattctgtgcatgcacttgacctaggactcgatattttctaatgctctaccttgataatgcagccaccaccagtgtgcgcaatgaagcacttgaggccatgtggccttatctcaccggagcgtttggcaatccgtcaagtccccatgaggtgggaagactcgcctctgcggggctggaggatgctcgaactcgggtggcccgcattatcggaggacgccccacacaggtgacgtttacgtcgggtggatcagaagccaacaacctcgctatcaaaggagcgtgcttagctaatcctcgtggccggcacctcatcaccaccccgatcgagcatgacagtgtcctagaaactgctgcttatcttgaaaggtttcatgatttcgagatcacctacctatcccccgatcacactgggctgatctccccggagggtctccgcaaagcagtcaggccggacaccacattgatcagcattggttatgccaacaatgaggtgggaaccattcagccgatagctgagttggcggcggtaagcagtacgccttttcacaccgatgcagtgcaagctgcacatttaacctttgacttgggagttgacgcgttaagtttgtcgggtcataaattcggtgcgcctaaagggattggagtgttatggtcaaagcttcccctggagccggtaatccatggcggcggccaggaaaaagggcggcgtagtggcacggaaaacgttgcgggggctatcgcctttgccactgccttggaattggccagggcggaatcctatccagatcttggcgaattcatcgaggaagttctcactatcccgggagcacacctgactggacatcctaggatgcgcattgatggacacgcatcttttctcttcgacagcataggatctgaaactgttcttctggaattggaacgccaaggcattgtgtgctcccctggttctgcctgtggttccggagaggtatcccatgtgttgctggcgttggggcttgaggaggatcaagcacgaacggctgtgcgctgtacttttagtacaacacacagccgtgaagatgcgctcgtggcagcctctgctcttaaatccgcggtcgccttaatcagagggtgacgctagtcagaggtttacgg

SEQ ID NO: 648 - protein, 358 aa, Corynebacterium glutamicum
MLYLDNAATTSVRNEALEAMWPYLTGAFGNPSSPHEVGRLASAGLEDARTRVARIIGGRPTQVTFTSGGSEANNLAIKGACLANPRGRHLITTPIEHDSVLETAAYLERFHDFEITYLSPDHTGLISPEGLRKAVRPDTTLISIGYANNEVGTIQPIAELAAVSSTPFHTDAVQAAHLTFDLGVDALSLSGHKFGAPKGIGVLWSKLPLEPVIHGGGQEKGRRSGTENVAGAIAFATALELARAESYPDLGEFIEEVLTIPGAHLTGHPRMRIDGHASFLFDSIGSETVLLELERQGIVCSPGSACGSGEVSHVLLALGLEEDQARTAVRCTFSTTHSREDALVAASALKSAVALIRG

SEQ ID NO: 649 - DNA, 920 bp, Corynebacterium glutamicum
  CDS (79)..(897): FRXA00262
cacacaggtgacgtttacgtcgggtggatcagaagccaacaacctcgcttatcaaaggagcgtgcttagctaatcctagtggccgggcacctcatcaccaccccgatcgagcatgacagtgtcctagaaactgctgcttatcttgaaaggtttcatgatttcgagatcacctacctatcccccgatcacactgggctgatctccccggagggtctccgcaaagcagtcaggccggacaccacattgatcagcattggttatgccaacaatgaggtgggaaccattcagccgatagctgagttggcggcggtaagcagtacgccttttcacaccgatgcagtgcaagctgcacatttaacctttgacttgggagttgacgcgttaagtttgtcgggtcataaattcggtgcgcctaaagggattggagtgttatggtcaaagcttcccctggagccggtaatccatggcggcggccaggaaaaagggcggcgtagtggcacggaaaacgttgcgggggctatcgcctttgccactgccttggaattggccagggcggaatcctatccagatcttggcgaattcatcgaggaagttctcactatcccgggagcacacctgactggacatcctaggatgcgcattgatggacacgcatcttttctcttcgacagcataggatctgaaactgttcttctggaattggaacgccaaggcattgtgtgctcccctggttctgcctgtggttccggagaggtatcccatgtgttgctggcgttggggcttgaggaggatcaagcacgaacggctgtgcgctgtacttttagtacaacacacagccgtgaagatgcgctcgtggcagcctctgctcttaaatccgcggtcgccttaatcagagggtgacgctagtcagaggtttacgg

SEQ ID NO: 650 - protein, 273 aa, Corynebacterium glutamicum
VAGHLITTPIEHDSVLETAAYLERFHDFEITYLSPDHTGLISPEGLRKAVRPDTTLISIGYANNEVGTIQPIAELAAVSSTPFHTDAVQAAHLTFDLGVDALSLSGHKFGAPKGIGVLWSKLPLEPVIHGGGQEKGRRSGTENVAGAIAFATALELARAESYPDLGEFIEEVLTIPGAHLTGHPRMRIDGHASFLFDSIGSETVLLELERQGIVCSPGSACGSGEVSHVLLALGLEEDQARTAVRCTFSTTHSREDALVAASALKSAVALIRG

SEQ ID NO: 651 - DNA, 1296 bp, Corynebacterium glutamicum
  CDS (101)..(1273): RXN00435
cgacaggtgaattcatgcacgtttgagtgtcccgtgtgtggggtaatgttgtccaagagagtggaaggaaatgctgtggcggttgaaaggagtgcctttcgtgggttttgatgtggccagggttcgggggctttatacctctttgggcgatggctggacgtaccttaattcacatcaaattccgcaggttccggagcgggtggcgtcgggagttgcggcggctttccgcacgcatgcgcagatttctgaggtgacgtcgcagccgattgcggtggatcagttggaggctgctcgcgaggcagttgcgtcgttggcgggtgtggatccggactgtgttgtgctgggtcccacgaggcagtttttggctcatacattggcgcgcggtttgggtgggtttgtacgtcgaaaagcgggcgtggtgttgtcgcgcgcggacgcggactggctgaccgcgccgttccgctccctcgacggcgtttttagctgggccgagcccgatttgggcaccggcatgctgccggattggcagtacgagaagcttgttgacggctcgacgcgccttgtcgtgctcagcgccgcgcacccgctgctcggcacggtcgccccagtgggcaagattgtggataaagtgcgggcgcgttcgcgtgcctgggtgcttgtcgacgccaccacctacgcagcctaccgccccctgcgcctagacgagtgggaagccgatatcgtcatgcttgatctcggcgagttgggcggcccgcagatttcggcgttgattttccgtgatacctcgatgttcccgcgcctggatcgcaccgttccactcgaactgcccgcaagctccctgccgcatgggctgctcggcggcgtgcccaacctggtgcggcacctgggaaacctggatgaaaacgccccgtccgtcgttgaggcgatgggggagatggcgaaattccacaagggactttttgagcatcttgtggaatcgctcgaaggacttcacgcggtgcatatcgtgggaatttccggcgatgccgcaggtcaagacgccccgttcctggatcgagtgccccgcttgaccttcaccatggaaggcgtgcccgcagatatggtgtaccgccgattggtggacaatcgtttgatcactaccgtcagccctgctgacccgctgctcgaagcaatgggtgtgactgaagctggcggatcgatcactatcggactaagcccgtttagcacctactatgaagtggatcagctgaccagggtgctggcatcgcttgcctaaaccgcaagcacgagcttgcc

SEQ ID NO: 652 - protein, 391 aa, Corynebacterium glutamicum
VGFDVARVRGLYTSLGDGWTYLNSHQIPQVPERVASGVAAAFRTHAQISEVTSQPIAVDQLEAAREAVASLAGVDPDCVVLGPTRQFLAHTLARGLGGFVRRKAGVVLSRADADWLTAPFRSLDGVFSWAEPDLGTGMLPDWQYEKLVDGSTRLVVLSAAHPLLGTVAPVGKIVDKVRARSRAWVLVDATTYAAYRPLRLDEWEADIVMLDLGELGGPQISALIFRDTSMFPRLDRTVPLELPASSLPHGLLGGVPNLVRHLGNLDENAPSVVEAMGEMAKFHKGLFEHLVESLEGLHAVHIVGISGDAAGQDAPFLDRVPRLTFTMEGVPADMVYRRLVDNRLITTVSPADPLLEAMGVTEAGGSITIGLSPFSTYYEVDQLTRVLASLA

SEQ ID NO: 653 - DNA, 638 bp, Corynebacterium glutamicum
  CDS (1)..(615): FRXA00435
gtcgacgccaccacctacgcagcctaccgccccctgcgcctagacgagtgggaagccgatatcgtcatgcttgatctcggcgagttgggcggcccgcagatttcggcgttgattttccgtgatacctcgatgttcccgcgcctggatcgcaccgttccactcgaactgcccgcaagctccctgccgcatgggctgctcggcggcgtgcccaacctggtgcggcacctgggaaacctggatgaaaacgccccgtccgtcgttgaggcgatgggggagatggcgaaattccacaagggactttttgagcatcttgtggaatcgctcgaaggacttcacgcggtgcatatcgtgggaatttccggcgatgccgcaggtcaagacgccccgttcctggatcgagtgccccgcttgaccttcaccatggaaggcgtgcccgcagatatggtgtaccgccgattggtggacaatcgtttgatcactaccgtcagccctgctgacccgctgctcgaagcaatgggtgtgactgaagctggcggatcgatcactatcggactaagcccgtttagcacctactatgaagtggatcagctgaccagggtgctggcatcgcttgcctaaaccgcaagcacgagcttgcc

SEQ ID NO: 654 - protein, 205 aa, Corynebacterium glutamicum
VDATTYAAYRPLRLDEWEADIVMLDLGELGGPQISALIFRDTSMFPRLDRTVPLELPASSLPHGLLGGVPNLVRHLGNLDENAPSVVEAMGEMAKFHKGLFEHLVESLEGLHAVHIVGISGDAAGQDAPFLDRVPRLTFTMEGVPADMVYRRLVDNRLITTVSPADPLLEAMGVTEAGGSITIGLSPFSTYYEVDQLTRVLASLA

SEQ ID NO: 655 - DNA, 535 bp, Corynebacterium glutamicum
  CDS (101)..(535): FRXA02801
cgacaggtgaattcatgcacgtttgagtgtcccgtgtgtggggtaatgttgtccaagagagtggaaggaaatgctgtggcggttgaaaggagtgcctttcgtgggttttgatgtggccagggttcgggggctttatacctctttgggcgatggctggacgtaccttaattcacatcaaattccgcaggttccggagcgggtggcgtcgggagttgcggcggctttccgcacgcatgcgcagatttctgaggtgacgtcgcagccgattgcggtggatcagttggaggctgctcgcgaggcagttgcgtcgttggcgggtgtggatccggactgtgttgtgctgggtcccacgaggcagtttttggctcatacattggcgcgcggtttgggtgggtttgtacgtcgaaaagcgggcgtggtgttgtcgcgcgcggacgcggactggctgaccgcgccgttccgctccctcgacggcgtttttagctgggccgagcccgatttgggcaccggcatgctgccggattggcagtaccag

SEQ ID NO: 656 - protein, 145 aa, Corynebacterium glutamicum
VGFDVARVRGLYTSLGDGWTYLNSHQIPQVPERVASGVAAAFRTHAQISEVTSQPIAVDQLEAAREAVASLAGVDPDCVVLGPTRQFLAHTLARGLGGFVRRKAGVVLSRADADWLTAPFRSLDGVFSWAEPDLGTGMLPDWQYQ

SEQ ID NO: 657 - DNA, 1386 bp, Corynebacterium glutamicum
  CDS (101)..(1363): RXA02516
ttcattcacgttttcgcgaatggccagattgtgaccaccggtggcgctgagcttgctgacaagctcgaggctgacggctacgaccagttcatcaagtaacatgtccgatttcctcaatgcagatggatccctcaatgtggataaggtgcgggaagaattcccaatcctgaagcgcactgttagggatgggaaaccgcttgcttacctggactcaggtgcgacatcgcagcgacccgagcgggtgtggcgtgcagaggagcactttgtgctgcacaccaacgcccccgtgcaccgcggtgcctaccaactggctgaggaagcaacggatgcttatgaaggtgcccgcgagaagatcgctgcctttgttggtgccgagcagcatgaaattgcgttcactaagaatgcaactgaagcactcaatcttgttgcgtacaccttgggtgatgaccgttccggtaagtatcgtgtccaggccggggataccgtggtcatcacggagctagagcaccacgcaaacttggtgccatggcaggagctgtgccgtcgaaccggtgcgacattgaagtggtacaaggtgactgaagatggtcgcattgatctcgattcactcgagcttgatgaaactgtcaaggtcgttgccttcactcaccagtccaatgtgaccggtgctgtggctgatgttccagagttggttcgtcgtgccaaggctgtcggcgctctcacggtgcttgatgcgtgccagtctgttcctcatatgccagtgaatttccacgagctggatgtagatttctctgcattctctggccataagatgctgggacctgcaggcgtgggcgttgtgtatgcaaagtccccaatcttggatgaactgccaccatttttgactggtggttccatgattgaagttgtcaccatggagggttccacctacgctgccgcacctcaacgttttgaggccggcacgcagatgaccagccaggttgtgggcttgggtgctgccgtggacatgctgaatgaaatcggtatggaagcaatcgcagcgcatgagcacgcattgactgcttacgcgttggaaaagctcacggcaattaagggactaaccattgctggtcctttgactgcagagcagcgcggcggtgcaatcagcttcggtgtcgagggcattcacccacacgatctaggccaagtgcttgacgatcagggcgtgaatatccgcgtcggccaccactgcgcgtggcccgtgcaccgcagcatgaacgtacaatcgacagcaagagcatctttctatctctataacaccttcgaagaaatcgaccgcctcgcggcagcgatcgagaaggccaagcaattctttggagttgagtaatgaaccttgagcagatgtac

SEQ ID NO: 658 - protein, 421 aa, Corynebacterium glutamicum
MSDFLNADGSLNVDKVREEFPILKRTVRDGKPLAYLDSGATSQRPERVWRAEEHFVLHTNAPVHRGAYQLAEEATDAYEGAREKIAAFVGAEQHEIAFTKNATEALNLVAYTLGDDRSGKYRVQAGDTVVITELEHHANLVPWQELCRRTGATLKWYKVTEDGRIDLDSLELDETVKVVAFTHQSNVTGAVADVPELVRRAKAVGALTVLDACQSVPHMPVNFHELDVDFSAFSGHKMLGPAGVGVVYAKSPILDELPPFLTGGSMIEVVTMEGSTYAAAPQRFEAGTQMTSQVVGLGAAVDMLNEIGMEAIAAHEHALTAYALEKLTAIKGLTIAGPLTAEQRGGAISFGVEGIHPHDLGQVLDDQGVNIRVGHHCAWPVHRSMNVQSTARASFYLYNTFEEIDRLAAAIEKAKQFFGVE

SEQ ID NO: 659 - DNA, 570 bp, Corynebacterium glutamicum
  CDS (101)..(547): RXA02517
cgacagcaagagcatctttctatctctataacaccttcgaagaaatcgaccgcctcgcggcagcgatcgagaaggccaagcaattctttggagttgagtaatgaaccttgagcagatgtaccaggaggtgatcctggaccactacaaaaacccacagcacaagggccttcgggatcctttcgatgctgaggttcaccacgtcaacccttcttgtggcgacgaattgactctgcgcgtgaagctgtctgaggacggctccaccgtggaggacgtctcctacgaagcagttggttgctcaatcagccaggcctccacgtccgttatggccgaggagatcgtgggccaacccgtcgacaaggcgctggaaaagctcacagaatttgagaagatgatcgtttcccgcggtcagtttgttggcgatgaagatctcatcggagatggcgttgctttctccggagtcgccaagtacccggcacgcgtgaagtgcgcgctgcttgggtggaaggctttccaggcggcaaccgctgacgctgttgcgcacgcacattagcccgctgtattaattggagg

SEQ ID NO: 660 - protein, 149 aa, Corynebacterium glutamicum
MNLEQMYQEVILDHYKNPQHKGLRDPFDAEVHHVNPSCGDELTLRVKLSEDGSTVEDVSYEAVGCSISQASTSVMAEEIVGQPVDKALEKLTEFEKMIVSRGQFVGDEDLIGDGVAFSGVAKYPARVKCALLGWKAFQAATADAVAHAH

SEQ ID NO: 661 - DNA, 1167 bp, Corynebacterium glutamicum
  CDS (101)..(1144): RXA01747
cgaagtagagccgattgcagaatcggcggaatgagacgtcgaaaagcgtttaagctttccctaaaaatatcactaactcgaaagatgtaaggttgcatttgtgactatcgcacctgaaggacgacgactgctacgcgtcgaagctcgaaactcagaaaccccgattgagacgaagcctcgatggattagaaaccaggtcaaaaacggacctgagtatcaggatatgaaggaacgtgtcgctggcgcatcactacacactgtgtgtcaggaggctggctgtcctaatatccatgagtgttgggaatcccgtgaggcaaccttcctcattggtggcgccaactgctctcgccgctgtgatttctgcatgatcaactcggctcgccctgagccactcgaccgcggtgagccactgcgtgtcgctgagtctgttcgtgagatgcagctgaattactccaccatcaccggtgttacccgtgatgatctggatgatgaaggcgcatggctgtactcagaagtggttcgtaagatccacgagctgaacccacacaccggtgtggaaaacctggtgcctgatttctccggcaagaaggatctgctgcaggaagtttttgaatcccgcccagaggttttcgctcacaacgtggaaactgtgccacgtattttcaagcgcattcgcccagcattccgctacgagcgttcacttgatgtgatccgtcaggctcgcgatttcggtctggtgaccaagtccaacctgattttgggcatgggtgaaaccaaggaagaaatcaccgaggcgctgcaggatctgcacgacgctggctgtgacatcatcaccatcacccagtacctgcgtcctggtcctttgttccaccccatcgagcgttgggtgaagcctgaggagttcctcgagcacgctgatgctgcaaaggaaatgggcttcgctgctgttatgtccggcccattggttcgttcctcttaccgtgcaggccgtctgtacgcgcaggccatggagttccgtggcgaggaaatcccagcacacctcgcgcacctgaaggatacttccggaggatccaccgcccaggaagcatctacacttctggagcgttacggtgcttccgaagacaccccagtggtgtccttcaactaagcccgaagttttttaaccgc

SEQ ID NO: 662 - protein, 348 aa, Corynebacterium glutamicum
VTIAPEGRRLLRVEARNSETPIETKPRWIRNQVKNGPEYQDMKERVAGASLHTVCQEAGCPNIHECWESREATFLIGGANCSRRCDFCMINSARPEPLDRGEPLRVAESVREMQLNYSTITGVTRDDLDDEGAWLYSEVVRKIHELNPHTGVENLVPDFSGKKDLLQEVFESRPEVFAHNVETVPRIFKRIRPAFRYERSLDVIRQARDFGLVTKSNLILGMGETKEEITEALQDLHDAGCDIITITQYLRPGPLFHPIERWVKPEEFLEHADAAKEMGFAAVMSGPLVRSSYRAGRLYAQAMEFRGEEIPAHLAHLKDTSGGSTAQEASTLLERYGASEDTPVVSFN

SEQ ID NO: 663 - DNA, 876 bp, Corynebacterium glutamicum
  CDS (101)..(853): RXA01746
aaaccgccactcccctttcactggggagtggcggttttgtcgtttcatgcatgcagtgtgtgacttatcaaccttgttagggctagggtggatatctatcatgactgcaccaagagatccttttttccccgcagatctttctatccgcgcgtctgcagagcccattgaaattcagcggttgggtttgatcgattatcaagaggcctgggattatcaagcagagcttgctacccgtagggctaatgatgaaatccctgatcagctgcttattttggagcacccgtcggtgtataccgcaggtaagcgcacccagccggaagatcttcccaccaacggactgccggtgatcaatgctgatcgtggtggtcgcatcacgtggcatggtcctggccaattggtgatctatccgatcatcaaattagccgatccgatcgatgtggttgattacgtaagacgcctcgaggaagcgctcatccaagttgtcggcgatatgggtgttgccggcgctgggcgcattgatgggcgttcgggtgtgtgggtgccagctcatgatggttgggtggacagcaaggttgcggccatcggcattcgaataactcgtggtgttgcaatgcacggtgtggccatcaactgcaacaacacgttggatttctatgagcacatcattccgtgtggcattgctgatgcaggcttgagcacactctcgagggaactgaaaagggacgtttcagttgaggaattagtcgagccatcgatccgcgcattggatgatgctttggctggtcggctggttgtttctgatcattctttcggcagcgcgcccgacccaactaagaatctccctaaacgggggtagtacgaggaattttgtcggtg

SEQ ID NO: 664 - protein, 251 aa, Corynebacterium glutamicum
MTAPRDPFFPADLSIRASAEPIEIQRLGLIDYQEAWDYQAELATRRANDEIPDQLLILEHPSVYTAGKRTQPEDLPTNGLPVINADRGGRITWHGPGQLVIYPIIKLADPIDVVDYVRRLEEALIQVVGDMGVAGAGRIDGRSGVWVPAHDGWVDSKVAAIGIRITRGVAMHGVAINCNNTLDFYEHIIPCGIADAGLSTLSRELKRDVSVEELVEPSIRALDDALAGRLVVSDHSFGSAPDPTKNLPKRG

SEQ ID NO: 665 - DNA, 1179 bp, Corynebacterium glutamicum
  CDS (101)..(1156): RXA02106
ggtcgccgcttttcgacgcccgcctgcggcgggatgactgtgatggaggggcgcgtcgacaagcaaaatctctttagcaaattcggttactgtggggcgcatgaataaccattttgagctcaaagtacctggtggaaagcttgtcgtcgttgatgtgaccaccgatctggattccattgctgacgtgaagatttccggcgatttcttcctcgaacccgatgaggcattcttcgcccttggccgggcgctgcagggggcgtcggtgggtgataacactgatcgtttgcaggcaaagttggatgcagcgttggcggaatatgatgacgttgagctacacggctttagcactgcggatattgctttagctgtgcgtcgggcagtcaccggcgcgcaagatttcaccgattatgaatgggaaatcctgcacccaggggtgcttcctaccccacttaacgttgcgttggatgagctccttttggaccaagttgccagtggtcagcgtggcccgacgatgcgcatttgggattgggatgatcgcgccacagtgatcggtagtttccagtcatatgtcaatgaaatcaaccaagaaggcgttaatgaacatggtgtgaccgtggtacgacgcatgtctggtggcggtgcaatgtttatggagggcggcaactgcatcacctattccctgtatgcaccggaatctctcgttgctggtttgagctatgagcagtcctatgaatatttggatcgttgggtgattgctgcgctgaagacacacgatgttgacgcttggtacgtgcctatcaatgacatcacctccaccggcggaaaaatcggtggcgctgcacagaaacgtcgcagtggcgcagtcctccaccacgtgaccatgtcctatgacatcgatgcggacatgatgacccaggtgttgcgcattggaaaggtgaagatttccgacaagggtcttcgcagcgcaaagaagcgcgttgatcctctgcgccgccaaacaggtgcatcacgtgagcaaatcatcgacaccctaaagtccacattcagtgctaggtacggcgcgcaagaagtagagctcagcgatgaagatttcgcggcaggccacgacctagtaaaaaccaaatacgccaccgaggagtggactaagcgagttcaatagtttctatggatctgcacaag

SEQ ID NO: 666 - protein, 352 aa, Corynebacterium glutamicum
MNNHFELKVPGGKLVVVDVTTDLDSIADVKISGDFFLEPDEAFFALGRALQGASVGDNTDRLQAKLDAALAEYDDVELHGFSTADIALAVRRAVTGAQDFTDYEWEILHPGVLPTPLNVALDELLLDQVASGQRGPTMRIWDWDDRATVIGSFQSYVNEINQEGVNEHGVTVVRRMSGGGAMFMEGGNCITYSLYAPESLVAGLSYEQSYEYLDRWVIAALKTHDVDAWYVPINDITSTGGKIGGAAQKRRSGAVLHHVTMSYDIDADMMTQVLRIGKVKISDKGLRSAKKRVDPLRRQTGASREQIIDTLKSTFSARYGAQEVELSDEDFAAGHDLVKTKYATEEWTKRVQ

SEQ ID NO: 667 - DNA, 403 bp, Corynebacterium glutamicum
  CDS (101)..(403): RXS01183
cttgatatgacccgaacaccacacatcacaaattgaatcggtatcctttggggtattagtttccgttttaacgacacgacttgcgaggagtcttaaaataatggcgttctccgtagagatgcccgagctgggcgaatcagtaaccgaaggcacgatcacccagtggttgaagtctgttggtgacactgttgaggtagatgagccgttgctcgaggtctcaactgacaaggtcgacaccgagattccctctcctgtcgccggtgtcatcctagagattaaggctgaagaggatgacaccgtcgacgtcggcggtgtcattgcaataatcggcgatgctgatgagactcctgccaacgaagctcctgccgacgaggcaccagctcctgccgaagaggaagaacca

SEQ ID NO: 668 - protein, 101 aa, Corynebacterium glutamicum
MAFSVEMPELGESVTEGTITQWLKSVGDTVEVDEPLLEVSTDKVDTEIPSPVAGVILEIKAEEDDTVDVGGVIAIIGDADETPANEAPADEAPAPAEEEEP

SEQ ID NO: 669 - DNA, 1305 bp, Corynebacterium glutamicum
  CDS (101)..(1282): RXS01260
ctaaacgtgggctgcattccttccaaagtctctgatcaaaaacgctgaagttgcccatacctttacccatgagaagaagaccttcggcatcaatggcgaagtgaccttcaactatgaggatgctcacaagcgttcccgtggcgtttccgacaagatcgttggaggcgttcattacttgatgaagaagaacaagatcatcgaaattcatggtcttggaaacttcaaggatgctaagactcttgaggtcaccgacggtaaggatgctggcaagaccatcacctttgatgactgcatcatcgcaaccggttcggtagtcaacaccctccgtggcgttgacttctcagagaacgttgtgtcttttgaagagcagattcttaaccctgttgcgccaaagaagatggtcattgttggtgcaggcgcaattggaatggaattcgcctacgttcttggtaactacggtgtagatgtaaccgtcatcgagttcatggatcgtgtgcttccaaatgaagatgctgaagtctccaaggttattgcaaaggcctacaagaagatgggcgttaagcttcttcctggccatgcaaccactgctgttcgggacaacggtgactttgtcgaggttgattaccagaagaagggctctgacaagacagagactcttactgttgatcgagtcatggtttccgttggtttccgtccacgcgttgagggatttggtcttgaaaacactggcgttaagctcaccgagcgtggcgcaatcgagatcgatgattacatgcgtaccaacgtcgatggcatttacgccatcggtgacgtgaccgccaagcttcagcttgctcacgtcgcagaagcacagggcattgttgccgcagagactattgctggtgcagaaactcagactcttggtgattacatgatgatgccacgtgcaaccttctgcaacccacaggtttcttcctttggttacaccgaagagcaggccaaggagaagtggccagatcgtgagatcaaggttgcttccttcccattctctgcaaacggtaaagcagttggcctggcagaaactgatggtttcgcaaagatcgttgctgatgcagaattcggtgagctgctcggtgcacacctggttggagcaaatgcatcagagctcatcaatgaattggtgcttgctcagaactgggatctcaccactgaagagatctctcgtagcgtccatattcacccaacgctatctgaggcagttaaggaagctgcacacggtatctctggacacatgatcaacttctagaatccacctcgttggccctg

SEQ ID NO: 670 - protein, 394 aa, Corynebacterium glutamicum
VTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 671 - DNA, 294 bp, Corynebacterium glutamicum
  CDS (101)..(271): RXS01261
gtgggtgtttttcattttcttccactctaaaattaagtatggaaaaccaaccgcacccggatgcacgacaatgacccactaaacacgtatccttgaatgcgtgactgaacattatgacgtagtagtactcggagccggccccggtggctatgtctccgccatccgtgcagcgcagcttggcaagaaggttgctgtaattgagaagcagtactggggtggtgtttgcctaaacgtgggctgcattccttccaaagtctctgatcaaaaacgctgaagttgcccatacctttaccc

SEQ ID NO: 672 - protein, 57 aa, Corynebacterium glutamicum
VTEHYDVVVLGAGPGGYVSAIRAAQLGKKVAVIEKQYWGGVCLNVGCIPSKVSDQKR

SEQ ID NO: 673 - DNA, 1005 bp, Corynebacterium glutamicum
  CDS (101)..(982): RXA02717
aggcatgtccctaacgaacatcccagcctcatctcaatgggcaattagcgacgttttgaagcgtccttcacccggccgagtacctttttctgtcgagtttatgccaccccgcgacgatgcagctgaagagcgtctttaccgcgcagcagaggtcttccatgacctcggtgcatcgtttgtctccgtgacttatggtgctggcggatcaacccgtgagagaacctcacgtattgctcgacgattagcgaaacaaccgttgaccactctggtgcacctgaccctggttaaccacactcgcgaagagatgaaggcaattcttcgggaatacctagagctgggattaacaaacctgttggcgcttcgaggagatccgcctggagacccattaggcgattgggtgagcaccgatggaggactgaactatgcctctgagctcatcgatcttattaagtccactcctgagttccgggaattcgacctcggtatcgcctccttccccgaagggcatttccgggcgaaaactctagaagaagacaccaaatacactctggcgaagctgcgtggaggggcagagtactccatcacgcagatgttctttgatgtggaagactacctgcgacttcgtgatcgccttgtcgctgcagaccccattcatggtgcgaagccaatcattcctggcatcatgcccattacgagcctgcggtctgtgcgtcgacaggtcgaactctctggtgctcaattgccgagccaactagaagaatcacttgttcgagctgcaaacggcaatgaagaagcgaacaaagacgagatccgcaaggtgggcattgaatattccaccaatatggcagagcgactcattgccgaaggtgcggaagatctgcacttcatgacgcttaacttcacccgtgcaacccaagaagtgttgtacaaccttggcatggcgcctgcttggggagcagagcacggccaagacgcggtgcgttaagccctcttaggaatcatgaa

SEQ ID NO: 674 - protein, 294 aa, Corynebacterium glutamicum
MPPRDDAAEERLYRAAEVFHDLGASFVSVTYGAGGSTRERTSRIARRLAKQPLTTLVHLTLVNHTREEMKAILREYLELGLTNLLALRGDPPGDPLGDWVSTDGGLNYASELIDLIKSTPEFREFDLGIASFPEGHFRAKTLEEDTKYTLAKLRGGAEYSITQMFFDVEDYLRLRDRLVAADPIHGAKPIIPGIMPITSLRSVRRQVELSGAQLPSQLEESLVRAANGNEEANKDEIRKVGIEYSTNMAERLIAEGAEDLHFMTLNFTRATQEVLYNLGMAPAWGAEHGQDAVR

SEQ ID NO: 675 - DNA, 601 bp, Corynebacterium glutamicum
  CDS (101)..(601): RXN02027
tcacgtgctcatcgataggcaaactcatggaaccaagagtacctgcccccgcaaccccaatcgtcgtacccctccgaaaataacggttatccttagatttatgagccaaactaagcaggaactgcgcacgaagcttcgggaagcgcgcaccaatatggatgaggcttctcgcacgcgagaaaacgcagccatcattgccaacgtttcttattacatccgctcaaagcagccaaaaaggattgccgcttacgtgccggtgcgtaccgaacctggtgggcgattgcttcttgacgccctccacgccgaaacttccgcgcttattttgccagtctccctcgaggatcgacgcctcgactgggctctttatgaaggcccaaccagccttgttcctggcgcatttggcatccaggaacccggtggcactcgccttggacctgaagctctcaacttctgcgaccttgtcatcgcccccgcactggcatgcacccccagtggaatcaggctaggtaaaggtggcggtttctacgaccgcgctctagccaccggagtcaaggctgacgtgattactttgctcttcaacggagaaatccgcgacgatatc

SEQ ID NO: 676 - protein, 167 aa, Corynebacterium glutamicum
MSQTKQELRTKLREARTNMDEASRTRENAAIIANVSYYIRSKQPKRIAAYVPVRTEPGGRLLLDALHAETSALILPVSLEDRRLDWALYEGPTSLVPGAFGIQEPGGTRLGPEALNFCDLVIAPALACTPSGIRLGKGGGFYDRALATGVKADVITLLFNGEIRDDI

SEQ ID NO: 677 - DNA, 595 bp, Corynebacterium glutamicum
  CDS (101)..(595): FRXA02027
tcacgtgctcatcgataggcaaactcatggaaccaagagtacctgcccccgcaaccccaatcgtcgtacccctccgaaaataacggttatccttagatttatgagccaaactaagcaggaactgcgcacgaagcttcgggaagcgcgcaccaatatggatgaggcttctcgcacgcgagaaaacgcagccatcattgccaacgtttcttattacatccgctcaaagcagccaaaaaggattgccgcttacgtgccggtgcgtaccgaacctggtgggcgattgcttcttgacgccctccacgccgaaacttccgcgcttattttgccagtctccctcgaggatcgacgcctcgactgggctctttatgaaggcccaaccagccttgttcctggcgcatttggcatccaggaacccggtggcactcgccttggacctgaagctctcaacttctgcgaccttgtcatcgcccccgcactggcatgcacccccagtggaatcaggctaggtaaaggtggcggtttctacgaccgcgctctagccaccggagtcaaggctgacgtgattactttgctcttcaacggagaaatccgcgac

SEQ ID NO: 678 - protein, 165 aa, Corynebacterium glutamicum
MSQTKQELRTKLREARTNMDEASRTRENAAIIANVSYYIRSKQPKRIAAYVPVRTEPGGRLLLDALHAETSALILPVSLEDRRLDWALYEGPTSLVPGAFGIQEPGGTRLGPEALNFCDLVIAPALACTPSGIRLGKGGGFYDRALATGVKADVITLLFNGEIRD

SEQ ID NO: 679 - DNA, 579 bp, Corynebacterium glutamicum
  CDS (101)..(556): RXA00106
tggagctcaacaaggcagcgtacatgtttgagtacagcttcgatgacatcaccgtgtccggctacgatccacacccattgatccgcggcaaggtcgccgtatgatcggtgcgatttgggcacaaggccgtgacggcatcatcggcgacggcaccgacatgccctggcacatcccggaagacctcaaacacttcaagaaaaccaccatgggccagccggtcatcatgggtcgtcgcacgtgggagtctttgccgttcaagccgcttcccggccgcgagaacttcattctctcctcacgcgagcccggcgactggtccgccggcggcacagtggtcaccgaaatccctaaaagcggctggatcatgggcggcggcgaggtctacaaggccaccgtcggcagcgccgacgttttagaaataacgcttatcgacgccaccttcgatgtttccactcccgtctacgcacccgaaatcccggcgaacttcaacctcgatgacgaatccgagtggtttacctcaggcgagtatcgttacaagttccagcgctacatcaaggtttaaggagcaaacaacatgagcaa

SEQ ID NO: 680 - protein, 152 aa, Corynebacterium glutamicum
MIGAIWAQGRDGIIGDGTDMPWHIPEDLKHFKKTTMGQPVIMGRRTWESLPFKPLPGRENFILSSREPGDWSAGGTVVTEIPKSGWIMGGGEVYKATVGSADVLEITLIDATFDVSTPVYAPEIPANFNLDDESEWFTSGEYRYKFQRYIKV

SEQ ID NO: 681 - DNA, 1044 bp, Corynebacterium glutamicum
  CDS (101)..(1021): RXN01321
ggagggtgtagtcaaggatttgggccatggtggagcgggaaatcgtcatatccataccctacttagacctgacttagtgtgggaaaatttccagggtagaatgcaacgaatgaccccgagttctcctgaagttcgtaatcgtccgagcgctgcgcctgaagagcgtcagtttgtgctcacttttggctgccctgactccactggaattgtggcgaagttgtcgtcgttcctagctgagcgtgggggttggattactgaggctggatatttcacggatcctgattcgaattggttctttactcgtcaggcgattcgcgctgagtcgattgataccacgattgagcagttgcgggaggagttcgctccgcttgcggaggagttcggcccgagggctaagtggagtttcactgacactgcgcaggtgaagaaggctgtgttgttggtgtctaaggagggccactgcttgcacgatttgttaggtcgtgtggctgagaatgattatccgatggaagttgttgcggttgtgggtaaccatgagaacttgcgttatattgcggagaaccataatgttccgtttttccatgtgccgtttcctaaggatgcggttggtaagcggaaggcgtttgaccaggtcgctgagattgtgaatggttatgatccggatgcgattgttttggctcgttttatgcagattttgccgccggatttgtgtgagatgtgggctggtcgtgtgttgaatattcatcacagtttcttgccgtcgtttatgggtgcgcgcccgtatcatcaggcgtatagccgtggtgtgaagttgattggtgcgacctgccattatgcgactggggatctggatgatggtccgatcattgagcaggatgttattcgtgtgacgcataaggatacgccgactgagatgcagcgtttgggccgcgatgcggagaagcaggtgctggctcgcggtttgcgtttccacttggaggaccgggtgctggtttacggtaaccgcacggttgtctttgattaaggctttttgcttttcgacgc

SEQ ID NO: 682 - protein, 307 aa, Corynebacterium glutamicum
MQRMTPSSPEVRNRPSAAPEERQFVLTFGCPDSTGIVAKLSSFLAERGGWITEAGYFTDPDSNWFFTRQAIRAESIDTTIEQLREEFAPLAEEFGPRAKWSFTDTAQVKKAVLLVSKEGHCLHDLLGRVAENDYPMEVVAVVGNHENLRYIAENHNVPFFHVPFPKDAVGKRKAFDQVAEIVNGYDPDAIVLARFMQILPPDLCEMWAGRVLNIHHSFLPSFMGARPYHQAYSRGVKLIGATCHYATGDLDDGPIIEQDVIRVTHKDTPTEMQRLGRDAEKQVLARGLRFHLEDRVLVYGNRTVVFD

SEQ ID NO: 683 - DNA, 582 bp, Corynebacterium glutamicum
  CDS (23)..(559): FRXA01321
cttgcacgatttgttaggtcgtgtggctgagaatgattatccgatggaagttgttgcggttgtgggtaaccatgagaacttgcgttatattgcggagaaccataatgttccgtttttccatgtgccgtttcctaaggatgcggttggtaagcggaaggcgtttgaccaggtcgctgagattgtgaatggttatgatccggatgcgattgttttggctcgttttatgcagattttgccgccggatttgtgtgagatgtgggctggtcgtgtgttgaatattcatcacagtttcttgccgtcgtttatgggtgcgcgcccgtatcatcaggcgtatagccgtggtgtgaagttgattggtgcgacctgccattatgcgactggggatctggatgatggtccgatcattgagcaggatgttattcgtgtgacgcataaggatacgccgactgagatgcagcgtttgggccgcgatgcggagaagcaggtgctggctcgcggtttgcgtttccacttggaggaccgggtgctggtttacggtaaccgcacggttgtctttgattaaggctttttgcttttcgacgc

SEQ ID NO: 684 - protein, 179 aa, Corynebacterium glutamicum
VAENDYPMEVVAVVGNHENLRYIAENHNVPFFHVPFPKDAVGKRKAFDQVAEIVNGYDPDAIVLARFMQILPPDLCEMWAGRVLNIHHSFLPSFMGARPYHQAYSRGVKLIGATCHYATGDLDDGPIIEQDVIRVTHKDTPTEMQRLGRDAEKQVLARGLRFHLEDRVLVYGNRTVVFD

SEQ ID NO: 685 - DNA, 975 bp, Corynebacterium glutamicum
  CDS (101)..(952): RXA00461
tgttgggagggatgacaggattgtcgaagataacgtgaagtgggtgttccggcatgtgtttgattgtaaggccttggaaaagggtggaataatagcgggcgtgactgcaatcaaacttgatggaaacttataccgcggggaaattttcgccgacttggaacagcgcgttgctgcgttgaaggagaaagggattgtgccggggcttgccaccgtgctggtgggtgatgacccagcgagccactcttacgtgaagatgaagcatcgtgactgtgagcagattggtgtgaactcgatccgtaaggatctgcctgctgatgtcacgcaggaagagcttttcgctgtcatcgatgaactgaacaacgatgattcttgcactggttacattgtgcagcttcctttgcctaagcacttggacgaaaacgctgtgctggagcgcattgatccagctaaggatgctgatggcctgcaccctgtaaacctgggcaagcttgtgctcaacgagccagctccactgccatgcaccccgaatggttccatcagcttgttgcgtcgtttcggcgttgagcttgatggcgcgaaggttgttgtcattggccgtggcgtcaccgttggtcgcccaattggcctgatgctgacccgccgttccgagaactccacggttactttgtgccacactggcacgaaggatctggctgcggagacccgtgcggctgacgtcatcattgctgcagctggtcagccgcacatgctgaccgcagacatggtcaagccaggcgcagcggtgctcgatgtcggcgtctcccgcaaggacggcaagttgcttggcgacgtccaccccgacgtgtgggaagtcgccggcgcggtctcaccaaacccaggcggcgttggccctctgacccgtgcattcttggtgcacaatgttgtcgagcgcgctgaaaagctggctggactctaaaaacacatgactaatcccgg

SEQ ID NO: 686 - protein, 284 aa, Corynebacterium glutamicum
VTAIKLDGNLYRGEIFADLEQRVAALKEKGIVPGLATVLVGDDPASHSYVKMKHRDCEQIGVNSIRKDLPADVTQEELFAVIDELNNDDSCTGYIVQLPLPKHLDENAVLERIDPAKDADGLHPVNLGKLVLNEPAPLPCTPNGSISLLRRFGVELDGAKVVVIGRGVTVGRPIGLMLTRRSENSTVTLCHTGTKDLAAETRAADVIIAAAGQPHMLTADMVKPGAAVLDVGVSRKDGKLLGDVHPDVWEVAGAVSPNPGGVGPLTRAFLVHNVVERAEKLAGL

SEQ ID NO: 687 - DNA, 711 bp, Corynebacterium glutamicum
  CDS (101)..(688): RXA01514
accacagaaatgcctgtcgttccagatcagcccatcgatggtgattccgggaagtccgctgagggcacacaggagaatccggaaaatgaaggagacaaccgtggataaccacgctgcagttcgcgagttcgatgaggagcgcgcaacagctgcgattcgtgagttgctcatcgctgtgggtgaggatccagatcgcgaaggcctgttggaaaccccagctcgagtggctagggcgtacaaggaaactttcgcgggtctgcatgaggatcccaccactgtgctggagaagacgttctctgagggccatgaagagttggttctggttcgtgagatcccgatttactccatgtgtgagcaccacttggtgccgttctttggcgtggcgcacattggttacattccgggtaagtccggcaaggtgactggcctgtccaagctggcgcgtttagcggatatgtttgctaagcgacctcaggttcaggagcgcttgacctcccaaattgcggatgctctcgtcgaaaagcttgatgcccaggccgtggccgtggtgattgaagctgagcacctgtgcatggccatgcgcggaatccgtaagcctggtgctgtgaccacgacgtctgcggtgcgcggcggttttaagaacaacgctgcctcccgcgctgaggtgttctccctgattcgggggcactaaatgaacgtatcctctttgac

SEQ ID NO: 688 - protein, 196 aa, Corynebacterium glutamicum
VDNHAAVREFDEERATAAIRELLIAVGEDPDREGLLETPARVARAYKETFAGLHEDPTTVLEKTFSEGHEELVLVREIPIYSMCEHHLVPFFGVAHIGYIPGKSGKVTGLSKLARLADMFAKRPQVQERLTSQIADALVEKLDAQAVAVVIEAEHLCMAMRGIRKPGAVTTTSAVRGGFKNNAASRAEVFSLIRGH

SEQ ID NO: 689 - DNA, 513 bp, Corynebacterium glutamicum
  CDS (101)..(490): RXA01516
tctgcacatatgggagcatggggtgtgcgcgtgcacgatgtcccagtatcaagggacgctgttgatgttgccgcattgtggcgaagtggaggaactcaccatggctgatcgtattgaacttaaaggccttgaatgcttcggacaccacggtgtgttcgactttgaaaaagagcaaggccagcccttcattgtggatgtcacctgctggatggatttcgatgccgcaggtgccagcgatgacctttccgacaccgtagattacggcgcgttggcattgttggttgctgaaatcgtggaaggcccatccagggatttgatcgagacggtggccacggaatctgcggatgctgtgatggctaaatttgatgcgcttcatgcggtggaagtaaccatccataagcccaaagcaccgatcccacgtacttttgctgacgtcgcggtggttgcccgacgttccaggaaatccatggctgctggaaggagcaacgcctaatgcatgcagttttgtccatc

SEQ ID NO: 690 - protein, 130 aa, Corynebacterium glutamicum
MADRIELKGLECFGHHGVFDFEKEQGQPFIVDVTCWMDFDAAGASDDLSDTVDYGALALLVAEIVEGPSRDLIETVATESADAVMAKFDALHAVEVTIHKPKAPIPRTFADVAVVARRSRKSMAAGRSNA

SEQ ID NO: 691 - DNA, 975 bp, Corynebacterium glutamicum
  CDS (101)..(952): RXA01515
taagcctggtgctgtgaccacgacgtctgcggtgcgcggcggttttaagaacaacgctgcctcccgcgctgaggtgttctccctgattcgggggcactaaatgaacgtatcctctttgaccatcccgggacgctgtttggtcatgggaattgtcaatgtcactgaggattccttttcggacggtggcaagtacattgacgttgatcaggcgatcgcgcatgccaaggaattggtggctgctggcgccgacatgattgatgtcggcggcgagtccacccggcctggggcagtgcgcgtcgacgcgtccgtggaacgggaccgggttgtgccggtcattaaggcgcttcacgacgccggcatccacacttccgtagacaccatgcgggcctccgtggcgcaggctgccgcgggcgctggcgtctccatgatcaacgacgtctctggcggtttggctgatcctgagatgttttctgtcatggcggaagcgcaaattcccgtgtgtttgatgcactggcgcaccctccaattcggtgatgccgcaggtcaggcagatcacggtggagacgttgtagccgatgtgcacgcagtgcttgatgatcttgtcgcccgcgccaccgctgctggtgtggccgaaaaccagatcgtgcttgatccaggtttgggttttgccaaatcacgtgaagacaactggcgtttgctgcaagcactgcccgagtttatttctggacctttccccatcctggtgggagcatcccggaagcgattcctggctggcgtgcgcaaagaccgtggcctagatgtcacccccattgatgccgacccagcaaccgcagcggtgaccgcagtgtctgcacatatgggagcatggggtgtgcgcgtgcacgatgtcccagtatcaagggacgctgttgatgttgccgcattgtggcgaagtggaggaactcaccatggctgatcgtattgaacttaaaggcc

SEQ ID NO: 692 - protein, 284 aa, Corynebacterium glutamicum
MNVSSLTIPGRCLVMGIVNVTEDSFSDGGKYIDVDQAIAHAKELVAAGADMIDVGGESTRPGAVRVDASVERDRVVPVIKALHDAGIHTSVDTMRASVAQAAAGAGVSMINDVSGGLADPEMFSVMAEAQIPVCLMHWRTLQFGDAAGQADHGGDVVADVHAVLDDLVARATAAGVAENQIVLDPGLGFAKSREDNWRLLQALPEFISGPFPILVGASRKRFLAGVRKDRGLDVTPIDADPATAAVTAVSAHMGAWGVRVHDVPVSRDAVDVAALWRSGGTHHG

SEQ ID NO: 693 - DNA, 859 bp, Corynebacterium glutamicum
  CDS (101)..(859): RXA02024
cactgatgacctggatcaggccgtcaaattcatcgtcgatgcacacgctggattggacgtagcgcgtctccacaattaagcagtggctacattaggtgttatgagttctttgccggtcatcatggccatcgtcaatcgcaccccggattctttctatgacaagggtgcgacatttgaggacaccgctgcgctaaacagggcagcggaggtcattgaacaaggcgccggcattgtcgatatcggtggggtgaaagccggcccgggggatttcgtgtcggcggaggaagagatcgaccgcgtggtgccaatcatcgctgcggtgcgagaacgttttcctgacattgatatttctgttgatacctggcgggcgtcggtggctgatgtcgcagtggcgcatggagcaacgctgatcaatgacacttgggccggccatgatcatgagttggtgcaggtagcagggcagcacaaggtgggttatgtctgctcgcacaccggcggggtgattccaagaacgcgaccatatcgggtgcatttcgatgacatcgtggccgatgtaattacggagaccaccaaattggcagagcaagctgttcgtgccggggtgccagaggaacgggtgtttattgatcccacccatgatttcgggaaaaacaccttccacggactggagcttttacgacggatcgatgaggtggttgccacgggctggccggtgctgatggccttgagtaataaggatttcattggggaaactttggaaaggggcgtcgataagcgtgttgctggcacgcttgctgccactgcctgggcggcggcgcgcggcgttgcggcttttcgcgtgcatgaagttgcggaaacc

SEQ ID NO: 694 - protein, 253 aa, Corynebacterium glutamicum
MSSLPVIMAIVNRTPDSFYDKGATFEDTAALNRAAEVIEQGAGIVDIGGVKAGPGDFVSAEEEIDRVVPIIAAVRERFPDIDISVDTWRASVADVAVAHGATLINDTWAGHDHELVQVAGQHKVGYVCSHTGGVIPRTRPYRVHFDDIVADVITETTKLAEQAVRAGVPEERVFIDPTHDFGKNTFHGLELLRRIDEVVATGWPVLMALSNKDFIGETLERGVDKRVAGTLAATAWAAARGVAAFRVHEVAET

SEQ ID NO: 695 - DNA, 579 bp, Corynebacterium glutamicum; identical to SEQ ID NO: 679
  CDS (101)..(556): RXA00106

SEQ ID NO: 696 - protein, 152 aa, Corynebacterium glutamicum; identical to SEQ ID NO: 680

SEQ ID NO: 697 - DNA, 1556 bp, Corynebacterium glutamicum
  CDS (1)..(1533): RXA00989
ggaattggcctagtggctaacaacgacggaatctttgattccgaaaatgatgacatcaccgtaggcgatgtcacgttgggcgagactggactgtctttgcccatcgatctcgccggtgaggtagaagcacctgcctccgaggagatcacccaagaagatttgctgcgccttgcccaggtggaagcagagttggatcaacgttggttggaaaccaaaattgatcccactttccgacgcatgagctacatgatggatctcatgggccaaccacagaattccttcccagcaattcacgtggctggcaccaacggtaagacctccaccacccgcatgatcgagtcgttgctgcgcgcattccaccgccgcaccggccggaccaccagcccgcacctgcagctggtaaccgaacgcatcgcgattgatggcaagcccatccacccgcgtgatttcgtgcggatctacgaagagattaagccctacatggagatgaccgacgcctggtcagaggccgagggcggaccgaagatgagcaagtttgaggcactcgtggccctcgcttacgcaggttttgccgacgctcctgttgacgtcgccgtcgttgaggttggtcttggcggacgctgggatgccactaacgtgatcaacgcagctgtttccgtgatcaccccggtgggcatggaccacgtggatcgcctgggcaacaccattggtgaaatcgctggtgaaaaggccggcatcatcaaggctcgtcctgcatctgaggatggcaccgagcctgagggcaacgttgtcatcgtgggcaagcaggagccagaagcaatgaacgtgattctgcagcaagccgtggacgtggacgcagctgttgctcgtttgaacatggaattcggcgtggtggaatccgccattgccgttggtggacagcagctcaccctgaagggtttgggcggcgaatacaccgacatcttcctcccactgtctggcgcgcaccaagcagataatgccgcggttgctctcgcagcagtggaagcatttttcggtgcatccgccggacgcccattggatatcgacacggtgcgcgaaggcttcgcacaagttcagtccccaggtcgcctcgagcgcctgcgctctgcaccaaccgtgttcatcgacgcagctcacaacccacacggtgccgcagcacttggtgcagcactagaccgtgactttgagttccgtcgcctcatcggtgtcatcggagtgctctgcgacaaggatgcccgcggcatcttggaatcacttgagccatacctgcatgaaattgtgtgcacccagactgcctcagagcgcgcattggacgcatacgatttagctgaatatgctcgagagatctacggcgatgagcgtgtgcacgtccaagaagatcttgctggcgcggtagaactcgctattgaactagcagaagacaccgatgtacagtccggatcaggtgttgtgatcaccggttcaatcgtgaccgccggcgatgcgcgcacgctgtttggaaaggaacctgcatgagcaagcgtgaagaatcaatt

SEQ ID NO: 698 - protein, 511 aa, Corynebacterium glutamicum
GIGLVANNDGIFDSENDDITVGDVTLGETGLSLPIDLAGEVEAPASEEITQEDLLRLAQVEAELDQRWLETKIDPTFRRMSYMMDLMGQPQNSFPAIHVAGTNGKTSTTRMIESLLRAFHRRTGRTTSPHLQLVTERIAIDGKPIHPRDFVRIYEEIKPYMEMTDAWSEAEGGPKMSKFEALVALAYAGFADAPVDVAVVEVGLGGRWDATNVINAAVSVITPVGMDHVDRLGNTIGEIAGEKAGIIKARPASEDGTEPEGNVVIVGKQEPEAMNVILQQAVDVDAAVARLNMEFGVVESAIAVGGQQLTLKGLGGEYTDIFLPLSGAHQADNAAVALAAVEAFFGASAGRPLDIDTVREGFAQVQSPGRLERLRSAPTVFIDAAHNPHGAAALGAALDRDFEFRRLIGVIGVLCDKDARGILESLEPYLHEIVCTQTASERALDAYDLAEYAREIYGDERVHVQEDLAGAVELAIELAEDTDVQSGSGVVITGSIVTAGDARTLFGKEPA

SEQ ID NO: 699 - DNA, 600 bp, Corynebacterium glutamicum
  CDS (101)..(577): RXA01517
tccataagcccaaagcaccgatcccacgtacttttgctgacgtcgcggtggttgcccgacgttccaggaaatccatggctgctggaaggagcaacgcctaatgcatgcagttttgtccatcggttccaacatggatgatcgctacgcgctgctcaacacagtgatcgaggaattcaaagatgagatcgtggcgcagtctgcgatctactcaaccccaccgtggggcattgaggatcaggatgaattcctcaacgcagtgctcgttgttgaggttgaagaaacccccatcgagttgctgcgccgtggccaaaaactcgaagaagccgccgagcgggtccgcgtccgcaaatgggggccacgcaccctcgatgtggatatcgtgcagatcattaaagatggggaagagatcctttctgaggatcccgaactgaccttgccacacccttgggcttggcagcgtgccttcgtgttgatcccttggttggaagcagaacctgatgccgtcctgcacggcacgaccattgcagaacatgtggataatcttgatcccacagacattgaaggtgtcaccaagatttaaggagtcgtggctttcatgca

SEQ ID NO: 700 - protein, 159 aa, Corynebacterium glutamicum
MHAVLSIGSNMDDRYALLNTVIEEFKDEIVAQSAIYSTPPWGIEDQDEFLNAVLVVEVEETPIELLRRGQKLEEAAERVRVRKWGPRTLDVDIVQIIKDGEEILSEDPELTLPHPWAWQRAFVLIPWLEAEPDAVLHGTTIAEHVDNLDPTDIEGVTKI

SEQ ID NO: 701 - DNA, 1983 bp, Corynebacterium glutamicum; identical to SEQ ID NO: 459
  CDS (101)..(1960): RXA00579

SEQ ID NO: 702 - protein, 620 aa, Corynebacterium glutamicum; identical to SEQ ID NO: 460

SEQ ID NO: 703 - DNA, 747 bp, Corynebacterium glutamicum; identical to SEQ ID NO: 461
  CDS (101)..(724): RXA00958

SEQ ID NO: 704 - protein, 208 aa, Corynebacterium glutamicum; identical to SEQ ID NO: 462

SEQ ID NO: 705 - DNA, 1266 bp, Corynebacterium glutamicum; identical to SEQ ID NO: 413
  CDS (101)..(1243): RXA02790

SEQ ID NO: 706 - protein, 381 aa, Corynebacterium glutamicum; identical to SEQ ID NO: 414

SEQ ID NO: 707 - DNA, 579 bp, Corynebacterium glutamicum; identical to SEQ ID NO: 679
  CDS (101)..(556): RXA00106

SEQ ID NO: 708 - protein, 152 aa, Corynebacterium glutamicum; identical to SEQ ID NO: 680

SEQ ID NO: 709 - DNA, 2599 bp, Corynebacterium glutamicum; identical to SEQ ID NO: 211
  CDS (101)..(2599): RXN02198

SEQ ID NO: 710 - protein, 833 aa, Corynebacterium glutamicum; identical to SEQ ID NO: 212

SEQ ID NO: 711 - DNA, 2578 bp, Corynebacterium glutamicum; identical to SEQ ID NO: 213
  CDS (101)..(2578): FRXA02198

SEQ ID NO: 712 - protein, 826 aa, Corynebacterium glutamicum; identical to SEQ ID NO: 214

SEQ ID NO: 713 - DNA, 2358 bp, Corynebacterium glutamicum; identical to SEQ ID NO: 225
  CDS (101)..(2335): RXN02085

SEQ ID NO: 714 - protein, 745 aa, Corynebacterium glutamicum; identical to SEQ ID NO: 226

SEQ ID NO: 715 - DNA, 1923 bp, Corynebacterium glutamicum; identical to SEQ ID NO: 227
  CDS (101)..(1900): FRXA02085

SEQ ID NO: 716 - protein, 600 aa, Corynebacterium glutamicum; identical to SEQ ID NO: 228

SEQ ID NO: 717 - DNA, 603 bp, Corynebacterium glutamicum; identical to SEQ ID NO: 229
  CDS (101)..(580): FRXA02086

SEQ ID NO: 718 - protein, 160 aa, Corynebacterium glutamicum; identical to SEQ ID NO: 230

SEQ ID NO: 719 - DNA, 1326 bp, Corynebacterium glutamicum; identical to SEQ ID NO: 231
  CDS (101)..(1303): RXN02648

SEQ ID NO: 720 - protein, 401 aa, Corynebacterium glutamicum; identical to SEQ ID NO: 232

SEQ ID NO: 721 - DNA, 548 bp, Corynebacterium glutamicum; identical to SEQ ID NO: 233
  CDS (1)..(525): FRXA02648

SEQ ID NO: 722 - protein, 175 aa, Corynebacterium glutamicum; identical to SEQ ID NO: 234

SEQ ID NO: 723 - DNA, 784 bp, Corynebacterium glutamicum; identical to SEQ ID NO: 235
  CDS (101)..(784): FRXA02658

SEQ ID NO: 724 - protein, 228 aa, Corynebacterium glutamicum; identical to SEQ ID NO: 236

SEQ ID NO: 725 - DNA, 551 bp, Corynebacterium glutamicum; identical to SEQ ID NO: 209
  CDS (1)..(528): RXS02197

SEQ ID NO: 726 - protein, 176 aa, Corynebacterium glutamicum; identical to SEQ ID NO: 210

SEQ ID NO: 727 - DNA, 546 bp, Corynebacterium glutamicum
  CDS (101)..(523): RXC00988
tagcagaagacaccgatgtacagtccggatcaggtgttgtgatcaccggttcaatcgtgaccgccggcgatgcgcgcacgctgtttggaaaggaacctgcatgagcaagcgtgaagaatcaattgagtacggaccattaggcaaaggccacgatccattaaaggatcccatgaagggtatccgaggtgtcatggccggcaccttagtgatggaagcaatcaccttaggtcttgttctcaccgtgattctgcgcgtggacgacggcatctactggaccaccttcaactgggtctatgtatcagcagtcgcgatcgcacactttgttgctgcatttctgcaaaggtttagttggtccatcccgatgaacatcgtgctgcaggttcttgcacttgccggtttctttgttcaccccgcgatgggcttcgccgccatcatcttcatcatcgcgtgggcgtacctgttctacctgcgctctaatctgattgatcgcatgaaacgcgggctgcttaccacgcagcacagctaagctttaaggccctccggggc

SEQ ID NO: 728 - protein, 141 aa, Corynebacterium glutamicum
MSKREESIEYGPLGKGHDPLKDPMKGIRGVMAGTLVMEAITLGLVLTVILRVDDGIYWTTFNWVYVSAVAIAHFVAAFLQRFSWSIPMNIVLQVLALAGFFVHPAMGFAAIIFIIAWAYLFYLRSNLIDRMKRGLLTTQHS

SEQ ID NO: 729 - DNA, 597 bp, Corynebacterium glutamicum
  CDS (101)..(574): RXC01518
agcagaacctgatgccgtcctgcacggcacgaccattgcagaacatgtggataatcttgatcccacagacattgaaggtgtcaccaagatttaaggagtcgtggctttcatgcagaaaacgtcagcgggttggttgatcgcaacgggaggtttcctcgccgctgtgtccgccattttgacgtggcgtttttatggatccatgacctctatttccatcacggtatccatcactttttggttgttggccgtggtgtgtggtttcgcaggtgtgaaggtccaaggtcgcctcgatgaggggctgatcggccaggacaaatcccaaatgaaccccgtgaccattgcctatctggccatgctgggtcgagcgtgtgcgtggggtggcgcaattttcggcggcgtttatgtgggaattggcagttatgtaatcccacgcgccggtgagttgtccgcagcatcgaatgatcttccgggagttattgcctgtgcgctgggcggaatcgcactctcagctgccggactttatttagagcgaagctgtgaggctccgcctccccaatctggcgaagcgatcagctagattggaattcatgaatcaag

SEQ ID NO: 730 - protein, 158 aa, Corynebacterium glutamicum
VAFMQKTSAGWLIATGGFLAAVSAILTWRFYGSMTSISITVSITFWLLAVVCGFAGVKVQGRLDEGLIGQDKSQMNPVTIAYLAMLGRACAWGGAIFGGVYVGIGSYVIPRAGELSAASNDLPGVIACALGGIALSAAGLYLERSCEAPPPQSGEAIS

SEQ ID NO: 731 - DNA, 723 bp, Corynebacterium glutamicum
  CDS (101)..(700): RXC01942
gccgcgaaattcggtgaaattgaaggtattcctgcagatcaggcaaattcttccacgactgtgatcaaggtcaacggcaagaacgagtaacctgggatccatgttgcgcattggactaacaggagggatcggcagcggtaaatctaccgttgccgatcttttgtcatctgaaggatttctcatcgtcgacgcggaccaagttgcccgcgatatcgtcgaacccggacaaccggcattagcagagctagctgaagcttttggccaagacatcttaaaacccgacggcactctagaccgcgcgggattagcagccaaagcatttgtcagcgaagaacaaacagcgctgctcaatgccattacccaccctcgtatcgccgaagagtcagctcgtcgattcaacgaagccgaagatcaaggcgccaaagttgcggtttatgacatgcctttgcttgtagaaaaaggccttgaccgcaagatggaccttgtcgtcgtagttgatgttgacgtagaggaacgcgtccgcagacttgtggaaaaacgtggcctcacagaggacgacgtgcggcgtcgaatcgcttctcaagtgcccgacgacgtcagacttaaagccgctgacatcgttgtggacaataacggcacgctagaggaccttcatgctgaagcaagcaagctgattgctgagattcttagtcgcgtgaattagcactaaaacatcgtcaaagt

SEQ ID NO: 732 - protein, 200 aa, Corynebacterium glutamicum
MLRIGLTGGIGSGKSTVADLLSSEGFLIVDADQVARDIVEPGQPALAELAEAFGQDILKPDGTLDRAGLAAKAFVSEEQTALLNAITHPRIAEESARRFNEAEDQGAKVAVYDMPLLVEKGLDRKMDLVVVVDVDVEERVRRLVEKRGLTEDDVRRRIASQVPDDVRLKAADIVVDNNGTLEDLHAEASKLIAEILSRVN

SEQ ID NO: 733 - DNA, 1194 bp, Corynebacterium glutamicum
  CDS (101)..(1171): RXN02802
ccttcgccgcctgctccgacctcgccgacgccgtcaaagcccaggtcccgatctggaaagagcaaacgcgcctcgacggctccaccgattgggtcggcctgtgaaaaacctcgacatcgcccgctaccgccgccaaattatgctcggcgaaatcggccagcaaaaacaacaatcgcttttcgacgctaaggtctccgtcatcggcgcaggcggcctcgggtcacccgccctgctctaccttgctggcgctggcgtcggccacatccacatcattgacgatgacctcgtcgacctctccaacctccaccgccaggtcattcacaccaccgctggcgttggaacacccaaggccgagtccgcgcgcgaagcaatgctggcactgaacccttccgttaaagtgacggtttctgtcaggcgactggactggtcaaatgcactttctgagctggcagattccgatgtgattttggatggctccgataacttcgacacccgacacctcgcatcctgggccgccgcaaaacttggcatcccccacgtctgggcatccatcctgggtttcgacgcccaactctccgtcttccacgccggccacggccccatctacgaagacctcttccccaccccgccaccacccggatccgtcccatcatgttcccaagcaggcgttttgggtccagttgtcggcgtaatgggctccgcgatggccatggaagccctgaaaatcatcaccggcgtgggcacacccttgatcggaaaactcggctactactcctccctcgacggcacctgggaatacatccccgtcgtcggttcgccggaggtgctggaacgggtgcttgggtctgctggtgtttcggggatttctggcggttttggtgaggtgctcgatgttcctcgagtttccgcgctggttgacggcgtttcgctcatcgacgtccgcgaaccctccgaattctccgcctactccatccccggcgcgcacaacaccccactgtccgccatccgcgaaggcgccatcccaccctccgtttccgcaggtaaagaggttatcgtctactgcgcagctggtgtccgctccgcacaagccatcgcaattttagaatccgcaggctacaccggaatgagcagcctcgacggcggaatcgaaggctggctagattccctagggtaaaaccaaggcgttgtgccacc

SEQ ID NO: 734 - protein, 357 aa, Corynebacterium glutamicum
VKNLDIARYRRQIMLGEIGQQKQQSLFDAKVSVIGAGGLGSPALLYLAGAGVGHIHIIDDDLVDLSNLHRQVIHTTAGVGTPKAESAREAMLALNPSVKVTVSVRRLDWSNALSELADSDVILDGSDNFDTRHLASWAAAKLGIPHVWASILGFDAQLSVFHAGHGPIYEDLFPTPPPPGSVPSCSQAGVLGPVVGVMGSAMAMEALKIITGVGTPLIGKLGYYSSLDGTWEYIPVVGSPEVLERVLGSAGVSGISGGFGEVLDVPRVSALVDGVSLIDVREPSEFSAYSIPGAHNTPLSAIREGAIPPSVSAGKEVIVYCAAGVRSAQAIAILESAGYTGMSSLDGGIEGWLDSLG

SEQ ID NO: 735 - DNA, 497 bp, Corynebacterium glutamicum
  CDS (7)..(474): FRXA02802
tccgcgatggccatggaagccctgaaaatcatcaccggcgtgggcacacccttgatcggaaaactcggctactactcctccctcgacggcacctgggaatacatccccgtcgtcggttcgccggaggtgctggaacgggtgcttgggtctgctggtgtttcggggatttctggcggttttggtgaggtgctcgatgttcctcgagtttccgcgctggttgacggcgtttcgctcatcgacgtccgcgaaccctccgaattctccgcctactccatccccggcgcgcacaacaccccactgtccgccatccgcgaaggcgccatcccaccctccgtttccgcaggtaaagaggttatcgtctactgcgcagctggtgtccgctccgcacaagccatcgcaattttagaatccgcaggctacaccggaatgagcagcctcgacggcggaatcgaaggctggctagattccctagggtaaaaccaaggcgttgtgccacc

SEQ ID NO: 736 - protein, 156 aa, Corynebacterium glutamicum
MAMEALKIITGVGTPLIGKLGYYSSLDGTWEYIPVVGSPEVLERVLGSAGVSGISGGFGEVLDVPRVSALVDGVSLIDVREPSEFSAYSIPGAHNTPLSAIREGAIPPSVSAGKEVIVYCAAGVRSAQAIAILESAGYTGMSSLDGGIEGWLDSLG

SEQ ID NO: 737 - DNA, 535 bp, Corynebacterium glutamicum
  CDS (101)..(535): FRXA00438
ccttcgccgcctgctccgacctcgccgacgccgtcaaagcccaggtcccgatctggaaagagcaaacgcgcctcgacggctccaccgattgggtcggcctgtgaaaaacctcgacatcgcccgctaccgccgccaaattatgctcggcgaaatcggccagcaaaaacaacaatcgcttttcgacgctaaggtctccgtcatcggcgcaggcggcctcgggtcacccgccctgctctaccttgctggcgctggcgtcggccacatccacatcattgacgatgacctcgtcgacctctccaacctccaccgccaggtcattcacaccaccgctggcgttggaacacccaaggccgagtccgcgcgcgaagcaatgctggcactgaacccttccgttaaagtgacggtttctgtcaggcgactggactggtcaaatgcactttctgagctggcagattccgatgtgattttggatggctccgataacttcgacacccgacacctcgcatcctgggccgccgcaaaacttggcatcccc

SEQ ID NO: 738 - protein, 145 aa, Corynebacterium glutamicum
VKNLDIARYRRQIMLGEIGQQKQQSLFDAKVSVIGAGGLGSPALLYLAGAGVGHIHIIDDDLVDLSNLHRQVIHTTAGVGTPKAESAREAMLALNPSVKVTVSVRRLDWSNALSELADSDVILDGSDNFDTRHLASWAAAKLGIP

SEQ ID NO: 739 - DNA, 579 bp, Corynebacterium glutamicum
  CDS (101)..(556): RXN00437
ttcatcatggcgctgcccggctccacgggtgcggcgcgcgatgccaccgctgtcctcgacccactcattgatcacatcactggaactctgcaaggccaccatgaacactgaccccgcttacgtcgccgaacaaaccggcaaactcatcgacgctttcctcaccaccgaccccctcgaaccgctgctcgacgccgccaaaaacggcgtctgcacagaggcgatgggcgcgctggtcaccttcgaaggcatcgtccgcgaccacgacggcggcgcccgcgtgacctccctgacctacaccgcgcatcccaccgcgccgcaggtcctttctgctgtcgcggactccatcgttgaaaaacacccgcgcacccgcctctggaccgcgcaccgcaccggcgccttgaaaatcggtgacgccgccttcctcgtcgtcgccgcctccgcccaccgcgccgacgccttcgccgcctgctccgacctcgccgacgccgtcaaagcccaggtcccgatctggaaagagcaaacgcgcctcgacggctccaccgattgggtcggcctgtgaaaaacctcgacatcgcccgc

SEQ ID NO: 740 - protein, 152 aa, Corynebacterium glutamicum
MNTDPAYVAEQTGKLIDAFLTTDPLEPLLDAAKNGVCTEAMGALVTFEGIVRDHDGGARVTSLTYTAHPTAPQVLSAVADSIVEKHPRTRLWTAHRTGALKIGDAAFLVVAASAHRADAFAACSDLADAVKAQVPIWKEQTRLDGSTDWVGL

SEQ ID NO: 741 - DNA, 383 bp, Corynebacterium glutamicum
  CDS (1)..(360): FRXA00437
aaaaacggcgtctgcacagaggcgatgggcgcgctggtcaccttcgaaggcatcgtccgcgaccacgacggcggcgcccgcgtgacctccctgacctacaccgcgcatcccaccgcgccgcaggtcctttctgctgtcgcggactccatcgttgaaaaacacccgcgcacccgcctctggaccgcgcaccgcaccggcgccttgaaaatcggtgacgccgccttcctcgtcgtcgccgcctccgcccaccgcgccgacgccttcgccgcctgctccgacctcgccgacgccgtcaaagcccaggtcccgatctggaaagagcaaacgcgcctcgacggctccaccgattgggtcggcctgtgaaaaacctcgacatcgcccgc

SEQ ID NO: 742 - protein, 120 aa, Corynebacterium glutamicum
KNGVCTEAMGALVTFEGIVRDHDGGARVTSLTYTAHPTAPQVLSAVADSIVEKHPRTRLWTAHRTGALKIGDAAFLVVAASAHRADAFAACSDLADAVKAQVPIWKEQTRLDGSTDWVGL

SEQ ID NO: 743 - DNA, 591 bp, Corynebacterium glutamicum
  CDS (101)..(568): RXN00439
ctgccaccgcagactgtctgatcaggatcccggcgcggactacggtggaggaaaacgacatcgttaagatttacccattcaactaacaggagttaatttaatgagcgagctcacccacgttcgagcagacggttccgcacatatggtggatgtgacgggcaaaaatgaaacatcgagaactgctgttgccgaagggtttgtgaagatgaggggggacgtcgtaaagcagctttttagtgctggtctgcctaaaggcgacgcgctacctgtggcgcggattgcgggtatcatgggtgcgaagaagacgccggacattatccctttatgccacccgttgccgctgggcaaaattactgtggatttttttgagcttactgatggtgttcggattgaggcttcggtgaaaacgcgtggggttactggtgtggaaatggaggcgttgacggccgtgagcactgcggcgctgacggtatacgacatgatcaaggctgtggataagatggccgtgattgatggcattcgtgtgctgtcgaaaactggcggtaaatctggggattggtctgttcagtgacagctctggttatcgttgcg

SEQ ID NO: 744 - protein, 156 aa, Corynebacterium glutamicum
MSELTHVRADGSAHMVDVTGKNETSRTAVAEGFVKMRGDVVKQLFSAGLPKGDALPVARIAGIMGAKKTPDIIPLCHPLPLGKITVDFFELTDGVRIEASVKTRGVTGVEMEALTAVSTAALTVYDMIKAVDKMAVIDGIRVLSKTGGKSGDWSVQ

SEQ ID NO: 745 - DNA, 218 bp, Corynebacterium glutamicum
  CDS (1)..(195): FRXA00439
actgatggtgttcggattgaggcttcggtgaaaacgcgtggggttactggtgtggaaatggaggcgttgacggccgtgagcactgcggcgctgacggtatacgacatgatcaaggctgtggataagatggccgtgattgatggcattcgtgtgctgtcgaaaactggcggtaaatctggggattggtctgttcagtgacagctctggttatcgttgcg

SEQ ID NO: 746 - protein, 65 aa, Corynebacterium glutamicum
TDGVRIEASVKTRGVTGVEMEALTAVSTAALTVYDMIKAVDKMAVIDGIRVLSKTGGKSGDWSVQ

SEQ ID NO: 747 - DNA, 358 bp, Corynebacterium glutamicum
  CDS (101)..(358): FRXA00442
ctgccaccgcagactgtctgatcaggatcccggcgcggactacggtggaggaaaacgacatcgttaagatttacccattcaactaacaggagttaatttaatgagcgagctcacccacgttcgagcagacggttccgcacatatggtggatgtgacgggcaaaaatgaaacatcgagaactgctgttgccgaagggtttgtgaagatgaggggggacgtcgtaaagcagctttttagtgctggtctgcctaaaggggacgcgctacctgtggcgcggattgcgggtatcatgggtgcgaagaagacgccggacattatccctttatgccacccgttgccgctgggcaaaattactgtg

SEQ ID NO: 748 - protein, 86 aa, Corynebacterium glutamicum
MSELTHVRADGSAHMVDVTGKNETSRTAVAEGFVKMRGDVVKQLFSAGLPKGDALPVARIAGIMGAKKTPDIIPLCHPLPLGKITV

SEQ ID NO: 749 - DNA, 582 bp, Corynebacterium glutamicum
  CDS (101)..(559): RXA00440
cggtatacgacatgatcaaggctgtggataagatggccgtgattgatggcattcgtgtgctgtcgaaaactggcggtaaatctggggattggtctgttcagtgacagctctggttatcgttgcgtccactcgcgccgctgccggggtgtatgaggatcgctctggcccaattttggtgtcgtggctgcgtgcaaaaggttttgacacacccgcccccgtgatcgtggcggacgccaacctgcccgcattcctggacgagctggaatttccgcaggtagtacttatttcaggcggcaccggactcacgcctgatgacatcaccgtggacactttaatcccgcgcctcgacaaagaaatccccggcatcgcccacgctttttggaattacagcatggacgccgtcccgaccgcagtattgtcgcgcaccgtcgcgggcaccatcggcggcagtttcatcatggcgctgcccggctccacgggtgcggcgcgcgatgccaccgctgtcctcgacccactcattgatcacatcactggaactctgcaaggccaccatgaacactgaccccgcttacgtcgccgaac

SEQ ID NO: 750 - protein, 153 aa, Corynebacterium glutamicum
VTALVIVASTRAAAGVYEDRSGPILVSWLRAKGFDTPAPVIVADANLPAFLDELEFPQVVLISGGTGLTPDDITVDTLIPRLDKEIPGIAHAFWNYSMDAVPTAVLSRTVAGTIGGSFIMALPGSTGAARDATAVLDPLIDHITGTLQGHHEH

SEQ ID NO: 751 - DNA, 1287 bp, Corynebacterium glutamicum
  CDS (101)..(1264): RXN00441
agccttgggagcggtgattatgcttttggctgtctatgtcctcatcattggagccatcggagcgttacgattgttttccaaggtgagaaaggtttaattgatgtctcgttcgccggagcaacatttggcagaaatttcagcgctgcttcccccacaaaagtccacgttcgtgaatctgcgcgaagcgttgggacgccgcacgttttcagcggtcactgcgcagtgggattcgccacgttttgataattcccaaatggatggcttcgcgcttggcccctcacatcttaacggtggcaccttcgcagtcggtccaaccattcccgctggtcatgatcctgatcagtggtacccacgaggcatcgaaaaagacatcgcgccgattatgacgggtgcgcgccttcctaaaaacaccgccgcgatcattcctgtggagaaaaccacaccgggaaatttcgacgccccacaggtagaaatccccgccaccccgcaaggtcagttcatacggttgcagggttcggatattactgccggcgacgagatcattccagcaggtacggagcttaactcggtgcacatcggggtgttggctagtcagtcgatcaagagcattgaagtcgcagcaaagccacgtgtcctcatcatcaccggcgggtctgaaatttcagaacagcacggacccgccacgatccctgatgccaacggccctctgcttcgttccctgtgcgcccgcaacaatatcgaggtcatcgcgggactgcacaccaacgacgatcctgaacgactccgctttgaactggaaaacgccattgaccagtatcaaccggatgtcatcatcacctctggcggtatcagccacggtaaatttgaggtgtttaggcagatcctcgaaggcaccccgaactcctggtttggacatgtcgatcagcagcctggcggtcctcaaggcatctccacttttgctgaaactcctgtcatttcacttcccggaaatccgatttccaccttggtgagtttcacacttttggtcgcgccagcgctcaaccgccagccgctccgccacctcgatgcccgcatcaccgctccggtccagggcttgcaagacaatcgcgagcaattccttcgcggcaccatcagttaccgcaacgggccacgtcctcgccacgcctctcctgggcaccagttcccacctgctggttcaagctgccaccgcagactgtctgatcaggatcccggcgcggactacggtggaggaaaacgacatcgttaagatttacccattcaactaac

SEQ ID NO: 752 - protein, 388 aa, Corynebacterium glutamicum
MSRSPEQHLAEISALLPPQKSTFVNLREALGRRTFSAVTAQWDSPRFDNSQMDGFALGPSHLNGGTFAVGPTIPAGHDPDQWYPRGIEKDIAPIMTGARLPKNTAAIIPVEKTTPGNFDAPQVEIPATPQGQFIRLQGSDITAGDEIIPAGTELNSVHIGVLASQSIKSIEVAAKPRVLIITGGSEISEQHGPATIPDANGPLLRSLCARNNIEVIAGLHTNDDPERLRFELENAIDQYQPDVIITSGGISHGKFEVFRQILEGTPNSWFGHVDQQPGGPQGISTFAETPVISLPGNPISTLVSFTLLVAPALNRQPLRHLDARITAPVQGLQDNREQFLRGTISYRNGPRPRHASPGHQFPPAGSSCHRRLSDQDPGADYGGGKRHR

SEQ ID NO: 753 - DNA, 815 bp, Corynebacterium glutamicum
  CDS (1)..(792): FRXA00441
atccccgccaccccgcaaggtcagttcatacggttgcagggttcggatattactgccggcgacgagatcattccagcaggtacggagcttaactcggtgcacatcggggtgttggctagtcagtcgatcaagagcattgaagtcgcagcaaagccacgtgtcctcatcatcaccggcgggtctgaaatttcagaacagcacggacccgccacgatccctgatgccaacggccctctgcttcgttccctgtgcgcccgcaacaatatcgaggtcatcgcgggactgcacaccaacgacgatcctgaacgactccgctttgaactggaaaacgccattgaccagtatcaaccggatgtcatcatcacctctggcggtatcagccacggtaaatttgaggtgtttaggcagatcctcgaaggcaccccgaactcctggtttggacatgtcgatcagcagcctggcggtcctcaaggcatctccacttttgctgaaactcctgtcatttcacttcccggaaatccgatttccaccttggtgagtttcacacttttggtcgcgccagcgctcaaccgccagccgctccgccacctcgatgcccgcatcaccgctccggtccagggcttgcaagacaatcgcgagcaattccttcgcggcaccatcagttaccgcaacgggccacgtcctcgccacgcctctcctgggcaccagttcccacctgctggttcaagctgccaccgcagactgtctgatcaggatcccggcgcggactacggtggaggaaaacgacatcgttaagatttacccattcaactaac

SEQ ID NO: 754 - protein, 264 aa, Corynebacterium glutamicum
IPATPQGQFIRLQGSDITAGDEIIPAGTELNSVHIGVLASQSIKSIEVAAKPRVLIITGGSEISEQHGPATIPDANGPLLRSLCARNNIEVIAGLHTNDDPERLRFELENAIDQYQPDVIITSGGISHGKFEVFRQILEGTPNSWFGHVDQQPGGPQGISTFAETPVISLPGNPISTLVSFTLLVAPALNRQPLRHLDARITAPVQGLQDNREQFLRGTISYRNGPRPRHASPGHQFPPAGSSCHRRLSDQDPGADYGGGKRHR

SEQ ID NO: 755 - DNA, 2358 bp, Corynebacterium glutamicum; identical to SEQ ID NO: 225
  CDS (101)..(2335): RXN02085

SEQ ID NO: 756 - protein, 745 aa, Corynebacterium glutamicum; identical to SEQ ID NO: 226

SEQ ID NO: 757 - DNA, 1923 bp, Corynebacterium glutamicum; identical to SEQ ID NO: 227
  CDS (101)..(1900): FRXA02085

SEQ ID NO: 758 - protein, 600 aa, Corynebacterium glutamicum; identical to SEQ ID NO: 228

SEQ ID NO: 759 - DNA, 603 bp, Corynebacterium glutamicum; identical to SEQ ID NO: 229
  CDS (101)..(580): FRXA02086

SEQ ID NO: 760 - protein, 160 aa, Corynebacterium glutamicum; identical to SEQ ID NO: 230

SEQ ID NO: 761 - DNA, 1326 bp, Corynebacterium glutamicum; identical to SEQ ID NO: 231
  CDS (101)..(1303): RXN02648

SEQ ID NO: 762 - protein, 401 aa, Corynebacterium glutamicum; identical to SEQ ID NO: 232

SEQ ID NO: 763 - DNA, 548 bp, Corynebacterium glutamicum; identical to SEQ ID NO: 233
  CDS (1)..(525): FRXA02648

SEQ ID NO: 764 - protein, 175 aa, Corynebacterium glutamicum; identical to SEQ ID NO: 234

SEQ ID NO: 765 - DNA, 784 bp, Corynebacterium glutamicum; identical to SEQ ID NO: 235
  CDS (101)..(784): FRXA02658

SEQ ID NO: 766 - protein, 228 aa, Corynebacterium glutamicum; identical to SEQ ID NO: 236

SEQ ID NO: 767 - DNA, 513 bp, Corynebacterium glutamicum; identical to SEQ ID NO: 689
  CDS (101)..(490): RXA01516

SEQ ID NO: 768 - protein, 130 aa, Corynebacterium glutamicum; identical to SEQ ID NO: 690

SEQ ID NO: 769 - DNA, 975 bp, Corynebacterium glutamicum; identical to SEQ ID NO: 691
  CDS (101)..(952): RXA01515

SEQ ID NO: 770 - protein, 284 aa, Corynebacterium glutamicum; identical to SEQ ID NO: 692

SEQ ID NO: 771 - DNA, 859 bp, Corynebacterium glutamicum; identical to SEQ ID NO: 693
  CDS (101)..(859): RXA02024

SEQ ID NO: 772 - protein, 253 aa, Corynebacterium glutamicum; identical to SEQ ID NO: 694

SEQ ID NO: 773 - DNA, 684 bp, Corynebacterium glutamicum
  CDS (101)..(661): RXA01719
ccatatggtcggtgcactggctggaagtggcggtattgcactggtgacttcgtcgattgccgaggacggtctggttgatgttgtgctggggagaatgtaaatgaatatcatcattcttgctggtggcgagggtaaacgcatgggtggggtggataaggctgctgtggcggtggatggtcgcacgctgctggatatcctgctttcacagctggatccagaagatgacgtcgtggtggtttcccccgcgatcatcgacggaatcacgactgtctgcgaggaacctccgcttggcgggccggtcgcgggaatcgaggcagggctgaattcttttgagcacgcccatgaattcactgcgattcttgccgtggacgcgccttattctgcagcgatgctgcccctacttcaggcacagattggcaaagccgatgtggccgtaacccttgctgccgatggctgggtacaaccgttgtgcgcgctgtggagaagtggcagcctagaagcggtgattcacagcctgggcgagactagaaatcgaccggcaaaagcgttactgaagcaagcgggacacattgtggaagtgggtggcgatggcactgaaaaagactacgatacggtggctgaactggaggtattgggcaacgtaacgctccctaaagcccactgatgagaaacgtgagctctgct

SEQ ID NO: 774 - protein, 187 aa, Corynebacterium glutamicum
MNIIILAGGEGKRMGGVDKAAVAVDGRTLLDILLSQLDPEDDVVVVSPAIIDGITTVCEEPPLGGPVAGIEAGLNSFEHAHEFTAILAVDAPYSAAMLPLLQAQIGKADVAVTLAADGWVQPLCALWRSGSLEAVIHSLGETRNRPAKALLKQAGHIVEVGGDGTEKDYDTVAELEVLGNVTLPKAH

SEQ ID NO: 775 - DNA, 1332 bp, Corynebacterium glutamicum
  CDS (101)..(1309): RXA01720
acacccgtttgagaatctcaacctcttaaaacagcgcgaactattgatttggcaactaccctatatatttgagtgtttattgtcgaaaaaggggtttcaagtggcacagcaacgcagcgtcgatgactatctttccattttgatagacagcgtcgcaccgcttccgccagtaaaaacccctatcctcggcgcgcatccgttaagtcaccttgcagaggatgttgtcgcgacaattcctatcccgaaatttactaattctgctgttgatggttacgccattttgaaagaagacatccatggcagcgggccgtggacatttcttgtgggcggtgatactccggcgggttctgcgccggcgagcattaataatggaaaagccatccgtgtgatgacaggtggacccgtcccatccaccaacaaggacatgatcgtggttccagtggagctcaccaatgctccggtggatcactcgcttcctacagaaatcacgatcaatgagctaccaggtgagaggaataatattcgccatgctggtgagcatcttaaagaaggcgaaattgcggttgctgcggggacggcatttgatgcgggtactgtgtcgacggtgatttcagttggccatgacactgtaaaagcccatccttgccctcgggttgcggtgatcactaccggtgatgagctaaaccagggaaatccctggggtatccctaattccaatgggccgatgctggttgcggagctaaaacgcgtggggattaaggatccgcagcatttccattccgatgattctgagactgcattgagggagacgctcgataagcctgcagaggttgcggatgtgatcatcactgtgggtgggatctcggcgggcgcgttcgatgtggtcaaagccgtgggaactaagactggtggttttgaattcttccccattgcgatgaagccgggtaaaccgcaaggtcatgggcagtggggcgacgcaaaagtggtgtgtctgccgggaaacccggtggcggcgtgggttagttttaggctctttgttgttccggtaattgagagattagggggtggaaagaggctggcgtcgataagcgaactccctgtggtggcgctgcgctcgaaccgggcgctgaaggcgcgggagggccccgtattggcgataccggtggcgattgattgggagaaaagaatggcaaattctcaggcacatcgatcccatatggtcggtgcactggctggaagtggcggtattgcactggtgacttcgtcgattgccgaggacggtctggttgatgttgtgctggggagaatgtaaatgaatatcatcattcttgc

SEQ ID NO: 776 - protein, 403 aa, Corynebacterium glutamicum
VAQQRSVDDYLSILIDSVAPLPPVKTPILGAHPLSHLAEDVVATIPIPKFTNSAVDGYAILKEDIHGSGPWTFLVGGDTPAGSAPASINNGKAIRVMTGGPVPSTNKDMIVVPVELTNAPVDHSLPTEITINELPGERNNIRHAGEHLKEGEIAVAAGTAFDAGTVSTVISVGHDTVKAHPCPRVAVITTGDELNQGNPWGIPNSNGPMLVAELKRVGIKDPQHFHSDDSETALRETLDKPAEVADVIITVGGISAGAFDVVKAVGTKTGGFEFFPIAMKPGKPQGHGQWGDAKVVCLPGNPVAAWVSFRLFVVPVIERLGGGKRLASISELPVVALRSNRALKAREGPVLAIPVAIDWEKRMANSQAHRSHMVGALAGSGGIALVTSSIAEDGLVDVVLGRM

SEQ ID NO: 777 - DNA, 1237 bp, Corynebacterium glutamicum
  CDS (2)..(1207): RXS03223
tccagagccagtgcgtattgctattgcagaggcactgggtttgatgtgcgcggaagaggttcaagctagtcgtgctttgccgggtttcgcgcaagcagcgattgatggttatgcggttcgagcagtcgatgtcggcggcgagaagtcgtttagccagcaactgccggttgctcctccggaaaaatccctgcccgtggtgggtgaagtagctgcgggttctcagcagccgttgcgcctgcagcctaaacaagcagtcatggtccacaccggtgcgccactgccgatgcttgcggatgcggtgctgcccatggcgtggtcagatcgtggccgcaaacgagtaaccgcgcagcgacctgtgcgctctggcgagtttgtgcgcaaagaaggcgatgacatccaaccgggagacatcgcagtcagcgccggcgcggtcttaggccctgcccaaattggtttgctcgcagctgttggtcgctccaaagtgttggtgtacccacgcccacgcatgtcggttatctccgtaggcgctgaacttgttgatattgatcgccagccaggcctcggccaggtttatgatgtcaattcctattctctggctgccgccggtagggaagcgggcgcagatgtgtaccgctacggcattgctgccggtgaacctcgtcgcatcaaagagatcattgaatcccagatgctgcgctcggaaatcatcgtcatcaccggagctgttggcggtgctggttcagctggcgtgcgccaggttctcaacgagctaggcgatatcgacaccgaacgcgtcgcaatgcaccccggttctgtccaaggattcggtctgctcggcgagaacaagattccatgcttccttctgccttccaatccggtggcgtcgttagttatttttgaaaccttcgtccgcccggtcgtgcgcatgagcctgggcaagagcaatgcggcgcgccgggttgttcgagctcgagcgctcaaccacgttgtgtctgtggcgggtcgaaaaggtttcatcaggtccaggctcatgcgcgatgcagaaacccaggactacctcgtggaggctttgggtggtgcaacgggcgcaccatcgcacctattggcaggattgtccgaagcaaacggtatgatccgcattccagaagatgtcacagaaatccgaccgggagatgtcgtggacgtgatcttccttgcccaaggtcgatagttcgatgcgtaatgcaccgtcaggtcc

SEQ ID NO: 778 - protein, 402 aa, Corynebacterium glutamicum
PEPVRIAIAEALGLMCAEEVQASRALPGFAQAAIDGYAVRAVDVGGEKSFSQQLPVAPPEKSLPVVGEVAAGSQQPLRLQPKQAVMVHTGAPLPMLADAVLPMAWSDRGRKRVTAQRPVRSGEFVRKEGDDIQPGDIAVSAGAVLGPAQIGLLAAVGRSKVLVYPRPRMSVISVGAELVDIDRQPGLGQVYDVNSYSLAAAGREAGADVYRYGIAAGEPRRIKEIIESQMLRSEIIVITGAVGGAGSAGVRQVLNELGDIDTERVAMHPGSVQGFGLLGENKIPCFLLPSNPVASLVIFETFVRPVVRMSLGKSNAARRVVRARALNHVVSVAGRKGFIRSRLMRDAETQDYLVEALGGATGAPSHLLAGLSEANGMIRIPEDVTEIRPGDVVDVIFLAQGR

SEQ ID NO: 779 - DNA, 1229 bp, Corynebacterium glutamicum
  CDS (1)..(1206): FRXA01970
ccagagccagtgcgtattgctattgcagaggcactgggtttgatgtgcgcggaagaggttcaagctagtcgtgctttgccgggtttcgcgcaagcagcgattgatggttatgcggttcgagcagtcgatgtcggcggcgagaagtcgtttagccagcaactgccggttgctcctccggaaaaatccctgcccgtggtgggtgaagtagctgcgggttctcagcagccgttgcgcctgcagcctaaacaagcagtcatggtccacaccggtgcgccactgccgatgcttgcggatgcggtgctgcccatggcgtggtcagatcgtggccgcaaacgagtaaccgcgcagcgacctgtgcgctctggcgagtttgtgcgcaaagaaggcgatgacatccaaccgggagacatcgcagtcagcgccggcgcggtcttaggccctgcccaaattggtttgctcgcagctgttggtcgctccaaagtgttggtgtacccacgcccacgcatgtcggttatctccgtaggcgctgaacttgttgatattgatcgccagccaggcctcggccaggtttatgatgtcaattcctattctctggctgccgccggtagggaagcgggcgcagatgtgtaccgctacggcattgctgccggtgaacctcgtcgcatcaaagagatcattgaatcccagatgctgcgctcggaaatcatcgtcatcaccggagctgttggcggtgctggttcagctggcgtgcgccaggttctcaacgagctaggcgatatcgacaccgaacgcgtcgcaatgcaccccggttctgtccaaggattcggtctgctcggcgagaacaagattccatgcttccttctgccttccaatccggtggcgtcgttagttatttttgaaaccttcgtccgcccggtcgtgcgcatgagcctgggcaagagcaatgcggcgcgccgggttgttcgagctcgagcgctcaaccacgttgtgtctgtggcgggtcgaaaaggtttcatcaggtccaggctcatgcgcgatgcagaaacccaggactacctcgtggaggctttgggtggtgcaacgggcgcaccatcgcacctattggcaggattgtccgaagcaaacggtatgatccgcattccagaagatgtcacagaaatccgaccgggagatgtcgtggacgtgatcttccttgcccaaggtcgatagttcgatgcgtaatgcaccgt

SEQ ID NO: 780 - protein, 402 aa, Corynebacterium glutamicum; identical to SEQ ID NO: 778

SEQ ID NO: 781 - DNA, 708 bp, Corynebacterium glutamicum
  CDS (101)..(685): RXA02629
tacctcgcagagccgggaggtagaggttactctgacgagtgagtaggtttaaaagagttaatctgcatctaatcaagtagccaagtatgagtgaggaacaatgagcaaggatccattgggaagtcttaccgatgttgtagacacacgagttccgcttccggatgttgaaccggatccggagttcctgaaggctacggaaaaagaattccacatggcatcccagaagcgcgctcttgttgtcctggtgggcgatcatgtcgctgaggcagatgggactggccgtttggttacggagctgctcttagagtctggcttcaacgtggacgctgtggtcagcgtgaagtctaagaagtctcagattaggcaagctattgaaaccgcagttgttggcggcgctgaccttgtgctgaccatcggcggagtgggcgttggtcctcgggataaaactcctgaggcaaccagcgctgtgttggaccaggacgtcccaggaatcgcgcaggcgcttcgttcctccggtttggcctgtggcgcggtggatgcaagtgtttcccgaggcgtagcgggcgtatccggctcaaccgtggtggtcaacctcgctgagtctcgttcggcaattcgtgatggcatggcaactctgacaccgttggttgattttgttgtagatcagcttcgcacttccgtggtttgagttggtcgggtgtgagtaga

SEQ ID NO: 782 - protein, 195 aa, Corynebacterium glutamicum
MSKDPLGSLTDVVDTRVPLPDVEPDPEFLKATEKEFHMASQKRALVVLVGDHVAEADGTGRLVTELLLESGFNVDAVVSVKSKKSQIRQAIETAVVGGADLVLTIGGVGVGPRDKTPEATSAVLDQDVPGIAQALRSSGLACGAVDASVSRGVAGVSGSTVVVNLAESRSAIRDGMATLTPLVDFVVDQLRTSVV

SEQ ID NO: 783 - DNA, 402 bp, Corynebacterium glutamicum
  CDS (101)..(379): RXA02318
gatatacgccacggtaccgcgtacaaaatcccgaatatgatcatggccaaaggaggtcagcagtaagcgcatgtgcgccattttaaggcaagatggggccatgaattcgcttttcgacgtctccccacactggtcctccgccaacgccaagctcaccgcacattttaacaccggaaaattctccactggcatgaaatttgtcaacctcattgccgactccgcagaagaagccaaccaccaccccgatatccttctcacctatggttttgtggaaatcaccctcaccagccacgatgtgggtgagataaccgaccgtgatgtcgccctagcaaaagtcatcgacgcccacgccaagaccttggccatttcggcagaggcttaaggttaaagattatgagcaac

SEQ ID NO: 784 - protein, 93 aa, Corynebacterium glutamicum
MNSLFDVSPHWSSANAKLTAHFNTGKFSTGMKFVNLIADSAEEANHHPDILLTYGFVEITLTSHDVGEITDRDVALAKVIDAHAKTLAISAEA

SEQ ID NO: 785 - DNA, 600 bp, Corynebacterium glutamicum; identical to SEQ ID NO: 699
  CDS (101)..(577): RXA01517

SEQ ID NO: 786 - protein, 159 aa, Corynebacterium glutamicum; identical to SEQ ID NO: 700

SEQ ID NO: 787 - DNA, 609 bp, Corynebacterium glutamicum
  CDS (101)..(586): RXN01304
atgcaggtaaacgaatttgtgcttatatcaacattcgtgattcggcaaaattaattaaactgaaaaaggggattaattacccccacttgaggagaaattgatgcccgcacagaacaaaaacctcccaggatccgtcatcgttgtgtctgatcggattaaatcgggagaaagaattgataaagcaggacccgtagcagtagaccttcttcaggaatcaggcgtggagatttccacattcaccgtcgtggaggagggctttgaacctgtccatcaagaattggttaaggcgttggcgcgccgggatcgcgtcatcatcaccatcggcggaacgggcgtggggcctagaaatcggacgccggaggccacagaaccgcacatcgatacgctactgccgggtctgatgacgcagattttgttctctggactgtccaataccgcgcaggcggggttatctcgggggctggtgggcttgagtgctcgcgattccacggccgcgctcatcgtcaacgcgccgagttcttccgggggcgtgcgcgacgcgctcggggtggtctgcccgcttttcggttccatttttgagcgtctttaaaagatttttgcttatcgacg

SEQ ID NO: 788 - protein, 162 aa, Corynebacterium glutamicum
MPAQNKNLPGSVIVVSDRIKSGERIDKAGPVAVDLLQESGVEISTFTVVEEGFEPVHQELVKALARRDRVIITIGGTGVGPRNRTPEATEPHIDTLLPGLMTQILFSGLSNTAQAGLSRGLVGLSARDSTAALIVNAPSSSGGVRDALGVVCPLFGSIFERL

SEQ ID NO: 789 - DNA, 1281 bp, Corynebacterium glutamicum
  CDS (101)..(1258): RXS02556
tgccatcatattaaggccaaattgcttggatcctgggatttatttaattagattaaatccgtagaaattagcccatgaagcatggaaaggcgaaaaccccttgatcgtttccacccagcccattactgatcgcagcgcactctcggcagaacacgcagaggtgatcaaagcaacgcttcctctcgtgggcggcaagattaatgagatcacgccggttttctacaacaagatgtttgcggctcacccagaattgatcgctaacaccttcaaccgtggcaatcagaagcaaggcgatcagcagaaggcgctggcggcttcgattgcaacgtttgccaccatgctcgttactcctgatgctcctgacccagttcagctgctgtcccgcattggccacaagcacgtgtccctcggcattactgctgatcagtacgacattgttcacgagcacctgttcgccgcaatcgttgaggttttgggagcggaaactgtcaccgcacctgtcgctgaagcctgggatgctgtctactggatcatggcaaatgtgctgatcggttttgagaacaacctttatgcttccaacgatctggagcctggcgacgtcttccgcgaagtcaccgtgaccgcgaagaagcagctcagcgcaaccgtctgggaatacaccctggcaggtgagctggttgccccagagccaggtcagtacacctccatcggagtagtgcttgacgacggcgcccgccagctgcgccagtacagcttgctcggcggctccgacaccgagtaccgcattgcggttgaggataacggcgaggtttctggattcctgcgtgatcgcgtatccgttggtgacaagattgaagccaccatcgcggccggcgacctggttcttaacaaggacaccaatccagttgtgctgatttcccagggcatcggctccaccccaatggtgggcatgctcgcaggtatgaaccctgaacgtgacgttgtggttttgcatgctgaccaggccgagtccacctacgcgcaggtggaggaagtgcaggggctcgtcgaaaagctccctaaggctgcgtttgaaatcttctaccgcgacaacgaccagtggctcgaggtcgctggccgcattccatcaggtgcgtccgtgtacctgtgcggtggcgtggaattcttgaagaacgtgcgtgagcagatcgaggcgctcgatgagcagcctcgcgacgtaaacttcgagctcttcgcaccaaacgactggctgatttcctaagcccacaccccagaacttcc

SEQ ID NO: 790 - protein, 386 aa, Corynebacterium glutamicum
LIVSTQPITDRSALSAEHAEVIKATLPLVGGKINEITPVFYNKMFAAHPELIANTFNRGNQKQGDQQKALAASIATFATMLVTPDAPDPVQLLSRIGHKHVSLGITADQYDIVHEHLFAAIVEVLGAETVTAPVAEAWDAVYWIMANVLIGFENNLYASNDLEPGDVFREVTVTAKKQLSATVWEYTLAGELVAPEPGQYTSIGVVLDDGARQLRQYSLLGGSDTEYRIAVEDNGEVSGFLRDRVSVGDKIEATIAAGDLVLNKDTNPVVLISQGIGSTPMVGMLAGMNPERDVVVLHADQAESTYAQVEEVQGLVEKLPKAAFEIFYRDNDQWLEVAGRIPSGASVYLCGGVEFLKNVREQIEALDEQPRDVNFELFAPNDWLIS

SEQ ID NO: 791 - DNA, 990 bp, Corynebacterium glutamicum
  CDS (101)..(967): RXS02560
ttggggcaagccagctaacgcatttcttgtggaaaccgcagacattgaggccgcccacgcggaacttctaagagcagtggaatgaaataatccggtgctgatgcagggcaactcgcttaatctggcagacaacagcgagagaaagaagcccatgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgtgggggttcctcgacgccggaatcgcagctcaaaacgctgcaattgctgcggagtcacttggattgggaacgctctatttgggttcggtgcgcaacgatgcggaagccgtgcacaaattgcttggccttccacctgagatcgtgcctgtcgtgggcttggaaatggggcatgcggatccgcctgaacctgccggaattaaacctcccctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtcgaaaagcttttcaaaaaccaacaggcagttccttaggggcgtgtttgagcgcgccgggtttgggctgagataaaagcatgattatggacgcct

SEQ ID NO: 792 - protein, 289 aa, Corynebacterium glutamicum
MQGNSLNLADNSERKKPMPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAAWGFLDAGIAAQNAAIAAESLGLGTLYLGSVRNDAEAVHKLLGLPPEIVPVVGLEMGHADPPEPAGIKPPLPQEAIVHWDTYTEKNLELIDSYDRALDTYYSRYGQHQLWSKQTAHRAASKSFSKTNRQFLRGVFERAGFGLR

SEQ ID NO: 793 - DNA, 1425 bp, Corynebacterium glutamicum
  CDS (101)..(1402): RXA00382
aaaacactattgaccaccccaatcgctgttgagagtttgtaaagttcgactgtcaacgagctggattggcttcacagattgaattaatacaatgacgcacatgacatcgtccaatacggctcgatccgcagagtggtttgaaaaggctcagaagctcacccctggtggtgtgaattctcctgttcgcgctttcggttcagttggcggacaagcccgtttcatcgaaaaagctcacggttcaacgctgatcgatgtggacggaaatgaatacgttgacctggtctgttcttggggccccatgctgatgggtcacgctcacccagcagtggtcgaggctgtgcagaaggccgtcgtggatggtctttctttcggcgctcccaccatcggtgaggttgagttggcccaagatatcgtcaagcgcacttctgtggaggaagtccgcctggtcaactccggcactgaggccaccatgtcggcggttcgtctggcgcgcggttacactcagcgttccaagattttgaagtttgagggctgctaccacggccacgtcgatgcgctgctcgcatctgctggttctggtgtcgcaactttcgctctgcctgattccccaggcatcaccggcgctcagacttctgacactattgttgttccttacaacgacattgaagccgtgcgcaacgcttttgcggagtacccaggcgagatcgcctgcatcatcgcagaggcagccggtggcaacatgggcaccgtcgctccaaaggacaactttaacgacaagcttctcgcgatcgctcacgctgacggcgcgctgctgatcctcgatgaagtcatgaccggcttccgcacctcttaccgtggctggttcggcgtagacaaggttgccgctgacctggtcaccttcggcaaggtcgtctccggcggcctacctgccgcagcgtttggcggcaaggctgaaatcatgaacatgctggccccacagggccccgtctaccaagcaggcacactgtccggcaacccggttgcggtcgcagctggtcgggcatcgcttaagcttgccgacgaatccctctacacaaccatcaacgccaacgcagatcgtctccacggtttgatctctgatgccttaacccacgaaggcgtagcccaccacattcagcgtgcctcaaacatgctgtctatccgttttgcagaaggtgagggccacaacttctctgatatgaaggcagccgacatcttccgcttcgcaccgttcttccacactttgctggacaacggcgtctacgcaccaccaagcgttttcgaaacctggtttgtgtcttccgctctcacggacgatgatttctccaagatcgagcaggcactcaagcccgccgcacgtgcagcagcagaagcgaaggcatcatgacgcaaaccattgtccatcta

SEQ ID NO: 794 - protein, 434 aa, Corynebacterium glutamicum
MTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 795 - DNA, 1233 bp, Corynebacterium glutamicum
  CDS (101)..(1210): RXA00156
accgagagcgtggtacgcctcatttagtttcctcctatgaatcttgatgtggttcatgcgtttttatgcaatatcaaccaaaagttggtacgatcctcatatgaatgaacgcacatcggatgcatttgacgccctccttgtgctctccttcggtggtcccgaagggcacgaggaggttcgtccgtttttggagaatgtcactcacggaagggggattccgccggaacgtctagatgaagtggcggttcattaccaccacttcggtggtatcagccccatcaatgcgctgaacagggaaattatcgccaatgtggaaaaagaattggcgtctcgcgatcacaagctgcctgtttattttggtaaccgcaactggaagccgtttgataatgaggccgctgaacaaatggctgatgacggcgtgaaaaacgcgctggtgttggcaacttccgcttggggtggctactccggttgtcggcagtaccaggaagatattcagggcatgatcaagcacctggagtctcaggggcagtcgatcacgttcaccaagctgcgtcagttctacgatcaccctcgttttgtctccaccatggctcaattggttcaggattcctacgcgaagcttcccgatgagctgcgagatgaggcgcgtctggtcttcaccgcgcactccattccactgactgcggacaatgctgcgggaacccctgaggatggctccttgtattccacacaggtcaaggaagcgtcagcactgattgctgaggctgttggtgtgtcagattttgatgtggtgtggcagtcccgctcgggtagcccgcacactccgtggctggagcctgacatcgtggatcacgcagtggagctcaacgagaagggtcaaaaagcgctcgttgtctgccctgtaggctttatttctgatcatatggaagtcatttgggatcttgattccgagctgatggaagaagccgagaagcgcaacatggtggtcgagcgtgtcgctaccgttggccccaccgatgaattcgcagcccttgtggttgatctcatcgaggaggcagagctcaagcgcgttatcgagcgccttggaaagctgccagcacgcggaagttccgtcaacggcgcaccgtgtggcgacggctgctgtggtaccgccaagcataaaaccgcgcgggtgaaccccaacgctcgctcagcggcgccagctgccaactaggagtgatagtccctcgcaaa

SEQ ID NO: 796 - protein, 370 aa, Corynebacterium glutamicum
MNERTSDAFDALLVLSFGGPEGHEEVRPFLENVTHGRGIPPERLDEVAVHYHHFGGISPINALNREIIANVEKELASRDHKLPVYFGNRNWKPFDNEAAEQMADDGVKNALVLATSAWGGYSGCRQYQEDIQGMIKHLESQGQSITFTKLRQFYDHPRFVSTMAQLVQDSYAKLPDELRDEARLVFTAHSIPLTADNAAGTPEDGSLYSTQVKEASALIAEAVGVSDFDVVWQSRSGSPHTPWLEPDIVDHAVELNEKGQKALVVCPVGFISDHMEVIWDLDSELMEEAEKRNMVVERVATVGPTDEFAALVVDLIEEAELKRVIERLGKLPARGSSVNGAPCGDGCCGTAKHKTARVNPNARSAAPAAN

SEQ ID NO: 797 - DNA, 810 bp, Corynebacterium glutamicum
  CDS (101)..(787): RXA00624
tccatgacgttttgaatggaaaatctccatttgtggagttagaagaagaccactagttttcaacaggacgacaacggccggacatgcgacaatacaatgcatgtccggccgtcttcttgtttcagtttctagtattttcgaccagacccgatcggcggctgacaggctcatttcagacctgcgagccgacggcatcgaggtctcattacttgtcgcaccccgcatcgatggggactggcgtctcgccaaagacaaagggaccctcgcgtggatggaacaacaacgcgaacgcggccacgaactcatcctcaacggtttcgaccaagcagttcagggacgtcgctcagaattcgccaaccttgaacggcacgaagcacgtcttcgccttaccggtgccattaggcaaatgcagaaaattggcttcgaattccaaatctttgccccacctcgttggagaatgtcagaaggcaccttcgcggtactcccagaatttgatttcaacgtcgccgcctcgaccaggggattacataacctcgacaccggcgaattcttggcgtgtagaaacctctccgtgggtgaaggttttggtgctgcaaaatggtggcgcaagaatgtcatcaaggctgtcactcgtggagcggaaaaaggaaatacagtgcgcttgtccgcatcggcgcgaaatctcaccaaccctaaagtcgcagctgacttccgggaagctgcattagctgccttggatttgggtgctcaggtgcaaacctattctcaggcggccgcacaactggcctagttggggaggttcggggcacc

SEQ ID NO: 798 - protein, 229 aa, Corynebacterium glutamicum
MSGRLLVSVSSIFDQTRSAADRLISDLRADGIEVSLLVAPRIDGDWRLAKDKGTLAWMEQQRERGHELILNGFDQAVQGRRSEFANLERHEARLRLTGAIRQMQKIGFEFQIFAPPRWRMSEGTFAVLPEFDFNVAASTRGLHNLDTGEFLACRNLSVGEGFGAAKWWRKNVIKAVTRGAEKGNTVRLSASARNLTNPKVAADFREAALAALDLGAQVQTYSQAAAQLA

SEQ ID NO: 799 - DNA, 956 bp, Corynebacterium glutamicum
  CDS (1)..(933): RXA00306
gattccggcattcccacgcagttggtggagggcagctggtttgaaccggttcgcgggcgcacctttgaccgcatcatcgccaacccgccgttcgtggtgggaccaccggaaattgggcatgtgtaccgcgattccggcatggatctagacggcgcgaccgcgttggtggtcaaagaagcctgcgcgcatctcaaccctggtggcaccgctcacctgctcggcgcatgggtgcattccgcggatcaatcgtggcagcagcgcgttgcagaatggttgccggataacggttatgttgcttgggttattgagcgcgacgccgtgagccccgcgcagtatgtgggcacgtggcttagtgatgagtccctcgatctgcgtagccccgaggcagcagcacgcaccaccgcgtggcttaaccactttgaaaaagccaaggttcaaggcgttggttttggtttcatcgccatccaacgtctggaggaagacgaggcggatgagaaatccgatatcttggctgaatccatgacccagtacttcgaggatcctctcggccctgaaattgaggagtacttcacccgcaccgcatggcttcgtgaacaaactcgcgattccattctgagctcccgcttcaaagttcgccctggcgtggcccgggaacaaatcagcctggccgatgcggaagaaggcatgggctttagtcctgtcacgttgaggctcacccgcaccgatggtcctcgttggtcccatgatgttgatgagcatgtggcttccatcgtcgcaggacttaacccacatggactcccctttgaagaaatcctggaaatgtacgcgatggctcaaggtatcgagggagaatccctgcacaacggcgccattgcggcgttggtggatctcatccgccacggattggtgttgcccgctgatcttctcgattcttaaataaggactgattgtgaaag

SEQ ID NO: 800 - protein, 311 aa, Corynebacterium glutamicum
DSGIPTQLVEGSWFEPVRGRTFDRIIANPPFVVGPPEIGHVYRDSGMDLDGATALVVKEACAHLNPGGTAHLLGAWVHSADQSWQQRVAEWLPDNGYVAWVIERDAVSPAQYVGTWLSDESLDLRSPEAAARTTAWLNHFEKAKVQGVGFGFIAIQRLEEDEADEKSDILAESMTQYFEDPLGPEIEEYFTRTAWLREQTRDSILSSRFKVRPGVAREQISLADAEEGMGFSPVTLRLTRTDGPRWSHDVDEHVASIVAGLNPHGLPFEEILEMYAMAQGIEGESLHNGAIAALVDLIRHGLVLPADLLDS

SEQ ID NO: 801 - DNA, 1263 bp, Corynebacterium glutamicum
  CDS (101)..(1240): RXA00884
catcttccgtttcataccctgcactctaccctgttcttaggaattcgctatgtttaacatcaattaatcatgtatagggggcaggcactaggcttggggcatgtcagtttttggtgtgtatattcatgtgccgttttgttcaactcggtgcggttattgcgatttcaacacctatactgctggggaattaggtagtactgcaggcccggacacctatcttgactcgttggaagttgagttggagatggctgtggcttcgctggataatcctcggcaggcggaaactatctttattggcgggggtaccccgtcgttgattggtgcggacggtttggccagggttttgggggctgtgcgcaatacttttggcattgcggatggtgcggaagtcaccacggagtccaatccggagtctacctcgcctgagttttttgatggcctgcgtgaggcgggctacaacaggatttcgttagggatgcagtcggcgtcgtcaagcgttttgaaggtgctggaccgcacgcacaccccagggcgcccggtggcggcggccaaggaggcacgtgaggcggggtttgagcatgtcaatttggacatgatttatggcacgccgacagagaccgatgatgatgtccgcaagacgctgaatgcggtgctcgaagcgaacgtggatcacgtgtctgcctattccttgatcgtgaaagatggcacggcgatggcgcgcaaggtgcacaagggcgagctgccagcgccggacgaggatgtctacgctgatcgttttgagcttatcgacgctcgcctgcgctcagctggtttcgattggtacgaggtgtccaactgggcgaaacccggcggagaatgcaagcacaacatgggctattgggtcgacggcgactggtggggcgcgggcccgggcgcgcactcgcacatcggcgaccgccgcttctacaacatcaagcacccagcgcgttactccgcgcagattgcggccggcgagctgcccattaaggaaacagagcggctgacggcggaagatcaccacaccgagcgcgtcatgcttggtttgcgcctgaaacaaggcgtgccgctgaaccttttcgcacccgcagcgcgcccggtcatcgaccgtcatatcgcagggggcctgctgcacgtcaatgcgctgggcaacctggcggtgaccgatgcgggacgtttgcttgccgacggcatcatcgccgacattttgcttagtgaagaagactaaatatttagtagggttacaga

SEQ ID NO: 802 - protein, 380 aa, Corynebacterium glutamicum
MSVFGVYIHVPFCSTRCGYCDFNTYTAGELGSTAGPDTYLDSLEVELEMAVASLDNPRQAETIFIGGGTPSLIGADGLARVLGAVRNTFGIADGAEVTTESNPESTSPEFFDGLREAGYNRISLGMQSASSSVLKVLDRTHTPGRPVAAAKEAREAGFEHVNLDMIYGTPTETDDDVRKTLNAVLEANVDHVSAYSLIVKDGTAMARKVHKGELPAPDEDVYADRFELIDARLRSAGFDWYEVSNWAKPGGECKHNMGYWVDGDWWGAGPGAHSHIGDRRFYNIKHPARYSAQIAAGELPIKETERLTAEDHHTERVMLGLRLKQGVPLNLFAPAARPVIDRHIAGGLLHVNALGNLAVTDAGRLLADGIIADILLSEED

SEQ ID NO: 803 - DNA, 522 bp, Corynebacterium glutamicum
  CDS (101)..(499): RXN02503
gcagcaccggcaaccacgtccgtcaacgcgtcagaactgccggatgcgggtatcgtcgcattcgtgaacgcaccttctgccacacaaacgagggagtaacatgaccttaaaaattggtacccgaggatccaaacttgccaccacccaagctggcaccatccgcgaccagctgaaacactacggacgcgacgctgaactgcacatcgtgaccacccctggtgatgtcaacatgtccccagtcgagcgtatcggcgtcggcgtgttcacccaggcgctgcgcgatgtgttgcattccggtgaatgcgatgtggctgtgcactccatgaaggatctgccgaccgccaccgatcctcgattccacctggtcgtgccaactcgtgcggactcgcgcgaggcccttatcgcccgcgacggcctgactctggctgagcttccagaaaggcgcaaaggtgggaacttccgctcctcgacgcatctcccagctcaaggcaatccgccctgacctggagattctcccactgc

SEQ ID NO: 804 - protein, 133 aa, Corynebacterium glutamicum
MTLKIGTRGSKLATTQAGTIRDQLKHYGRDAELHIVTTPGDVNMSPVERIGVGVFTQALRDVLHSGECDVAVHSMKDLPTATDPRFHLVVPTRADSREALIARDGLTLAELPERRKGGNFRSSTHLPAQGNPP

SEQ ID NO: 805 - DNA, 558 bp, Corynebacterium glutamicum
  CDS (101)..(535): FRXA02503
  misc_feature 409,421: n = a, g, c, or t
  VARIANT 96: Xaa = Ser
  VARIANT 99: Xaa = Gly
  VARIANT 106: Xaa = Ala or Pro
  VARIANT 107: Xaa = Asp or Glu
  VARIANT 109: Xaa = Gly or Trp
  VARIANT 110: Xaa = Leu
  VARIANT 112: Xaa = Phe
  VARIANT 114: Xaa = Lys
  VARIANT 115: Xaa = Gly or Ala
  VARIANT 116: Xaa = Glu or Gln
gcagcaccggcaaccacgtccgtcaacgcgtcagaactgccggatgcgggtatcgtcgcattcgtgaacgcaccttctgccacacaaacgagggagtaacatgaccttaaaaattggtacccgaggatccaaacttgccaccacccaagctggcaccatccgcgaccagctgaaacactacggacgcgacgctgaactgcacatcgtgaccacccctggtgatgtcaacatgtccccagtcgagcgtatcggcgtcggcgtgttcacccaggcgctgcgcgatgtgttgcattccggtgaatgcgatgtggctgtgcactccatgaaggatctgccgaccgccaccgatcctcgattccacctggtcgtgccaactcgtgcggactckcgccgaggsccttatcgcccncgacggsctgantttkggttragcttycaaaargsgsaaaggtgggaactttccgctcctcgacgcatctcccagctcaaggcaatccgccctgacctggagattctcccacttgcgcggaaacattgacaccggcatgggcaaggtca

SEQ ID NO: 806 - protein, 145 aa, Corynebacterium glutamicum
  VARIANT 96: Xaa = Ser
  VARIANT 99: Xaa = Gly
  VARIANT 106: Xaa = Ala or Pro
  VARIANT 107: Xaa = Asp or Glu
  VARIANT 109: Xaa = Gly or Trp
  VARIANT 110: Xaa = Leu
  VARIANT 112: Xaa = Phe
  VARIANT 114: Xaa = Lys
  VARIANT 115: Xaa = Gly or Ala
  VARIANT 116: Xaa = Glu or Gln
MTLKIGTRGSKLATTQAGTIRDQLKHYGRDAELHIVTTPGDVNMSPVERIGVGVFTQALRDVLHSGECDVAVHSMKDLPTATDPRFHLVVPTRADXRRXPYRPRRXXFXXSXQXXXRWELSAPRRISQLKAIRPDLEILPLARKH

SEQ ID NO: 807 - DNA, 1245 bp, Corynebacterium glutamicum
  CDS (101)..(1222): RXA00377
aatggcgctcgggcagggcgcgcaagtactaaccagcaattcccaagcccaaaaacccctcccatatagttctttttactgatgcattgtcctcaattaggtgtggcttcttttcctaaattgggataaatggggcaagattgagcgcatgtctgctcttactattccagctgcgcgtcgcacgctaaataacgcgcccattattgatgccgctaatggcaagaccccgactcgcactccggtgtggtttatgcgccaggcgggtaggtcgttgcctgagtacaagaaggtccgtgagggaatcagcatgttggattcctgtttcatgccggagttgttggcggagattactttgcagccggttcgtcgtcatgatgtggatgctgcgattttgttctctgacattgtggtgccgttgcgtgctgcgggtgttggtgtggaaatcgtggcgggtcgtggacctgtgttggatgcgccggtgcggagccgtggggatgtgttgaatcttcctattttggagggcaacgttccggaggtggagcagggtattggcatcattttggatgagttgtctgattctcaggcgttgattggttttgctggtgcgccgtttacgttggcgagttacttggttgagggtggtccttccaagaatcatgagaagaccaaagcaatgatgcatggtgatcctgagacgtggcatgcgttgatggctcgtttggtgccgacgattgtgaattctttgaagtcgcagatcgatgcgggtatcgatgcggtgcagttgtttgattcgtgggctgggttcctcactgagcgtgattacaccgagttcgtgttgccgtattccactgagattttggaggaagtgggcaagtaccagctgcctcgtattcactttggtgtgggtactggtgagttgcttggtgcgatgagcaaggctggctcagaggtcatgggtgtggattggcgggtgccgttggataaggctgcggagcgtattgctgcggtatcaggtcctaaggtgttgcagggtaacctcgatcctgcgttgttgtttgcgggtcgcgcacctttgactaaggaaattgagcgcatcaaggcagaggctcagactgctgttgatgcaggtcatgcaacgggccatatctttaaccttggtcatggtgtgcttcctaatacggtggcggaagatattactgaagccgtctccatcattcattcttaaactaagaggagtttcatgcg

SEQ ID NO: 808 - protein, 374 aa, Corynebacterium glutamicum
VWLLFLNWDKWGKIERMSALTIPAARRTLNNAPIIDAANGKTPTRTPVWFMRQAGRSLPEYKKVREGISMLDSCFMPELLAEITLQPVRRHDVDAAILFSDIVVPLRAAGVGVEIVAGRGPVLDAPVRSRGDVLNLPILEGNVPEVEQGIGIILDELSDSQALIGFAGAPFTLASYLVEGGPSKNHEKTKAMMHGDPETWHALMARLVPTIVNSLKSQIDAGIDAVQLFDSWAGFLTERDYTEFVLPYSTEILEEVGKYQLPRIHFGVGTGELLGAMSKAGSEVMGVDWRVPLDKAAERIAAVSGPKVLQGNLDPALLFAGRAPLTKEIERIKAEAQTAVDAGHATGHIFNLGHGVLPNTVAEDITEAVSIIHS

SEQ ID NO: 809 - DNA, 681 bp, Corynebacterium glutamicum
  CDS (101)..(658): RXN02504
cctcgattccacctggtcgtgccaactcgtgcggactcgcgcgaggcccttatcgcccgcgacggcctgactctggctgagcttccagaaaggcgcaaaggtgggaacttccgctcctcgacgcatctcccagctcaaggcaatccgccctgacctggagattctcccactgcgcggaaacattgacaccggcatgggcaaggtcacctccggtgaactcgatgctgtgatgctcgcctacgcaggcctcacccgcgtcggcatgcaggaccgcgcaacggaagttttcgacgccgacatcatcatgcccgcccccgcacagggcgcacttgcgatcgaatgccgcgccgacgacactgaaaccgtccgcgcgctcaacatgctgatgcacgccgacacgtttgtttccgcggttgcagaacgcaccgtgctcaaccgcctcgaagctggctgtaccgcgcctgtcgcagcgcacgccaccttggacggctactccggcgacaccatgactctcaccgccggcgtctacgcacttgacggctctgaccagctggtattctccgccgaaggtgacggcgcccgcccagaagagctcggcgagctcgttgcacaacagcttatcgacgccggagccgccaatttgctcggcgaccgcagctaattagggcccgaaatttccat

SEQ ID NO: 810 - protein, 186 aa, Corynebacterium glutamicum
VGTSAPRRISQLKAIRPDLEILPLRGNIDTGMGKVTSGELDAVMLAYAGLTRVGMQDRATEVFDADIIMPAPAQGALAIECRADDTETVRALNMLMHADTFVSAVAERTVLNRLEAGCTAPVAAHATLDGYSGDTMTLTAGVYALDGSDQLVFSAEGDGARPEELGELVAQQLIDAGAANLLGDRS

SEQ ID NO: 811 - DNA, 561 bp, Corynebacterium glutamicum
  CDS (101)..(538): FRXA02504
gcatctcccagctcaaggcaatccgccctgacctggagattctcccacttgcgcggaaacattgacaccggcatgggcaaggtcacctccggtgaactcgatgcttgtgatgctcgcctacgcaggcctcacccgcgtcggcatgcaggaccgcgcaacggaagttttcgacgccgacatcatcatgcccgcccccgcacagggcgcacttgcgatcgaatgccgcgccgacgacactgaaaccgtccgcgcgctcaacatgctgatgcacgccgacacgtttgtttccgcggttgcagaacgcaccgtgctcaaccgcctcgaagctggctgtaccgcgcctgtcgcagcgcacgccaccttggacggctactccggcgacaccatgactctcaccgccggcgtctacgcacttgacggctctgaccagctggtattctccgccgaaggtgacggcgcccgcccagaagagctcggcgagctcgttgcacaacagcttatcgacgccggagccgccaatttgctcggcgaccgcagctaattagggcccgaaatttccat

SEQ ID NO: 812 - protein, 146 aa, Corynebacterium glutamicum
MLVMLAYAGLTRVGMQDRATEVFDADIIMPAPAQGALAIECRADDTETVRALNMLMHADTFVSAVAERTVLNRLEAGCTAPVAAHATLDGYSGDTMTLTAGVYALDGSDQLVFSAEGDGARPEELGELVAQQLIDAGAANLLGDRS

SEQ ID NO: 813 - DNA, 1449 bp, Corynebacterium glutamicum
  CDS (101)..(1426): RXN01162
catcgaatacgtgccctgctgaatagatgacatcgcagagatctataagagtcagtggttgtcggggtttcacagtcacttattctatgcaggattcaccatgtatatcgtggggatttgtctacaattagtggttatgagccaaccgatgtcagcacccgactccgctccaggaacagagcgcggtcatgaacgcacccattttgcggtagtcggtgactcccaggatccagcacaggcaacagctcctagagcgccagcagaatcaattactttgattggtattggtaccgatgggtttgaggggctcggactcaaggcacagcaagcattacaacgtgcctctgtggtgattggatcatggcgccagctcaatctcgtacctgatgccattaaggcagagcgtcgcccatggccgggtaataccaagcatcctgatttagatgccttgtttaaagagttcctcggtcggcatgttgctgttctggcctctggcgatccactgttttacggcgtgggcaccgcaatggtccatgtgctggggatggatagactcacggttattccgggaccatcatccgcgtcgcttgcttgcgcccgcttgggttggacagtcaaccgcacacgggtggtgtacctaggacaagaacccattgagacactcatcccgattattgaatcaggcgctcaattcctcgtcttgggtaaagatgaattcagtacagctcaagttgccacgttgttgaatgaactcggactgggggagactccactgactgtgctcagcgatttgggcagtactgatgaggagatcacccaaggcacagcttcacatccaccagctgcagtgtctgttctcaacgtgattgctgtgggagctcgcaccgcaatgccgaaaccccactttgaaggcgacgtatcaaacgaagaccttcgggcactgaccgtggcagctctagaacccacccagggacaaatgctgtggaccttcggggatattggagcagcacttgcctgcgattggctacgcgcagccggcaacaaggcgcacgccattagttttgcctccatggttgagcaaagccaaaggaatgctcgcaaactaggtgtatccaccctcagtgtgaaagagaccctgtcacccaaaacgctcaaagatatccgctatgtacaaggaccagaatcagcaagcccacatgccatcttcatgaacaaaggcctaggcatcgatctagttcctgaaaccgcatggatgatgctgcggcctggaggaaagctcattgcgcaagcctccacagaagacaacatcgcaaagcttcacacactccaagaacaacacggcggaatcatcaaacacatccgcatcgacgacacagacgtgcaccaatggcgagttacaaagccggtgactccagaagcggtgaattagcatcaaaaaccaaccccatg

SEQ ID NO: 814 - protein, 442 aa, Corynebacterium glutamicum
MYIVGICLQLVVMSQPMSAPDSAPGTERGHERTHFAVVGDSQDPAQATAPRAPAESITLIGIGTDGFEGLGLKAQQALQRASVVIGSWRQLNLVPDAIKAERRPWPGNTKHPDLDALFKEFLGRHVAVLASGDPLFYGVGTAMVHVLGMDRLTVIPGPSSASLACARLGWTVNRTRVVYLGQEPIETLIPIIESGAQFLVLGKDEFSTAQVATLLNELGLGETPLTVLSDLGSTDEEITQGTASHPPAAVSVLNVIAVGARTAMPKPHFEGDVSNEDLRALTVAALEPTQGQMLWTFGDIGAALACDWLRAAGNKAHAISFASMVEQSQRNARKLGVSTLSVKETLSPKTLKDIRYVQGPESASPHAIFMNKGLGIDLVPETAWMMLRPGGKLIAQASTEDNIAKLHTLQEQHGGIIKHIRIDDTDVHQWRVTKPVTPEAVN

SEQ ID NO: 815 - DNA, 1345 bp, Corynebacterium glutamicum
  CDS (101)..(1345): FRXA01162
catcgaatacgtgccctgctgaatagatgacatcgcagagatctataagagtcagtggttgtcggggtttcacagtcacttattctatgcaggattcaccatgtatatcgtggggatttgtctacaattagtggttatgagccaaccgatgtcagcacccgactccgctccaggaacagagcgcggtcatgaacgcacccattttgcggtagtcggtgactcccaggatccagcacaggcaacagctcctagagcgccagcagaatcaattactttgattggtattggtaccgatgggtttgaggggctcggactcaaggcacagcaagcattacaacgtgcctctgtggtgattggatcatggcgccagctcaatctcgtacctgatgccattaaggcagagcgtcgcccatggccgggtaataccaagcatcctgatttagatgccttgtttaaagagttcctcggtcggcatgttgctgttctggcctctggcgatccactgttttacggcgtgggcaccgcaatggtccatgtgctggggatggatagactcacggttattccgggaccatcatccgcgtcgcttgcttgcgcccgcttgggttggacagtcaaccgcacacgggtggtgtacctaggacaagaacccattgagacactcatcccgattattgaatcaggcgctcaattcctcgtcttgggtaaagatgaattcagtacagctcaagttgccacgttgttgaatgaactcggactgggggagactccactgactgtgctcagcgatttgggcagtactgatgaggagatcacccaaggcacagcttcacatccaccagctgcagtgtctgttctcaacgtgattgctgtgggagctcgcaccgcaatgccgaaaccccactttgaaggcgacgtatcaaacgaagaccttcgggcactgaccgtggcagctctagaacccacccagggacaaatgctgtggaccttcggggatattggagcagcacttgcctgcgattggctacgcgcagccggcaacaaggcgcacgccattagttttgcctccatggttgagcaaagccaaaggaatgctcgcaaactaggtgtatccaccctcagtgtgaaagagaccctgtcacccaaaacgctcaaagatatccgctatgtacaaggaccagaatcagcaagcccacatgccatcttcatgaacaaaggcctaggcatcgatctagttcctgaaaccgcatggatgatgctgcggcctggaggaaagctcattgcgcaagcctccacagaagacaacatcgcaaagcttcacacactccaagaacaacacggcgga

SEQ ID NO: 816 - protein, 415 aa, Corynebacterium glutamicum
MYIVGICLQLVVMSQPMSAPDSAPGTERGHERTHFAVVGDSQDPAQATAPRAPAESITLIGIGTDGFEGLGLKAQQALQRASVVIGSWRQLNLVPDAIKAERRPWPGNTKHPDLDALFKEFLGRHVAVLASGDPLFYGVGTAMVHVLGMDRLTVIPGPSSASLACARLGWTVNRTRVVYLGQEPIETLIPIIESGAQFLVLGKDEFSTAQVATLLNELGLGETPLTVLSDLGSTDEEITQGTASHPPAAVSVLNVIAVGARTAMPKPHFEGDVSNEDLRALTVAALEPTQGQMLWTFGDIGAALACDWLRAAGNKAHAISFASMVEQSQRNARKLGVSTLSVKETLSPKTLKDIRYVQGPESASPHAIFMNKGLGIDLVPETAWMMLRPGGKLIAQASTEDNIAKLHTLQEQHGG

SEQ ID NO: 817 - DNA, 873 bp, Corynebacterium glutamicum
  CDS (101)..(850): RXA01692
gggctgatgcgaagtcagcttcgagtttgaaaggtgcagtattcatggttcaagcctagtgttcgggttctggcaattgttgggactaggattaatgcccatgacgatttcccaagaaaaccagccaataatccagccagtctccttaattggtggaggtcctggtgcatgggacttaattacggtgcgtgggatgaatcgccttcaggaggctgatgtcattttggctgatcacttggggcccactgatgagttggaaaaattgtgcgacatcagctcgaagactgttgttgatgtgtccaagcttccgtatgggcggcaggtcactcaggagcgtactaatgagatgcttgttgaatacgcacagcagggactaaaggtggttcgccttaaaggtggtgacccttatgtcttcggtcggggttttgaagagttggagtttttgggcgagcatggaattgaatgcgaggtcattccgggtgtgaccagtgcggtgtccgttccagcggcggcaggtattcctattactaatcggggagtggtgcattcctttaccgtggtgtctggacatttgcctccaggccatccgaagtcactggttgattgggctgcgttggccaaatcgggtggcaccttgtccatcatcatgggtgtgaaaaatgcgggtgcgattgcccaggcgctcatggacggcgggcttgatgcagatactccagcagctgttattcaggaaggcactactgatgcacaacgctcagttcggtgcaccttgggcacattgggtgcagtcatggtggaggaagagattaagcctccagctgtgtatgtcattggacaagttgctggcctctaagcagatcgcctaagaatggg

SEQ ID NO: 818 - protein, 250 aa, Corynebacterium glutamicum
MTISQENQPIIQPVSLIGGGPGAWDLITVRGMNRLQEADVILADHLGPTDELEKLCDISSKTVVDVSKLPYGRQVTQERTNEMLVEYAQQGLKVVRLKGGDPYVFGRGFEELEFLGEHGIECEVIPGVTSAVSVPAAAGIPITNRGVVHSFTVVSGHLPPGHPKSLVDWAALAKSGGTLSIIMGVKNAGAIAQALMDGGLDADTPAAVIQEGTTDAQRSVRCTLGTLGAVMVEEEIKPPAVYVIGQVAGL

SEQ ID NO: 819 - DNA, 1917 bp, Corynebacterium glutamicum
  CDS (101)..(1894): RXN00371
gtcgtggacaatcccggatcgaaaatttgattcggcttttttcatggctgttgatggagtacgttggtcgttttcgagacaagtactagaaaagatattgatgactatcgcccataagcccgagatggctgaaactaccgggatcgagaccaaccaggtttccgaaaccatcggggttgaatcgctcacgcacggaaacttacgtcctgtttcatcttttgagggacagcatgagggacaaacggaagagttacttccaggcaaagtcatttttgttggggccggtcccggtaaccctgatcttcttacagttcgtgcccgtgaagttctgggcaacgcggttcgtgcgattactgatgaacaagtactaagcggcgttcgagcttttgtcgccactgaaattcctgtgccggaagataagcttcaggctgcggaagatgagtacgagcgcatctgcattgaagcgaaggagaacggtgcacgccgtaagcctcctcgtccagcaccaccaaccgctgcagagatcacggaagtttctgaggcgactccagctcagattgttgagcttgtgcaggatgctctttcttatggtggagatgttattcgtcttgtcaccggcaacccattgagcagcgatgccacactggctgagatctctgcagtttccgaggctggcctggagttccaggtggttccaggtatgtctttgcctgcaacggttcctgcatttgcgggaattgcgttgggttctacctacaccgaaactgatgtcaacggtcaaaacttggactgggatcagttggctagcgcacctcagcctttggtgctgcaggcccgcgtggatgacctttcccgtattgcacaggaactaaaggcccgcaatatgtctttggaaactcctgtttctgtcaccgctaacggcaccacccgtttgcagcgcacctatgacaccactttaggtctgttgcacaagcttgatgctgaactaagcggacctttggttgttaccttgggcaagggtgtggatgatcgctccaagtactcttggtgggaaaaccgcgctctgtacggttggcgtgtgctggtgcctcgcgctcgggagcaagcggcatccatgtccgcacgtctgagcagccacggcgctatcccgcaggaagtccctaccatttctgtcgaaccaccgcgcaacccagcgcaaatggaacgcgccatcaagggcatcgtcgaaggacgctaccagtgggttgtcctcaccagcgtcaacgcagtgaaggcagtctgggagaaaatcaccgaattcggcctcgattcacgttccttcgcgggcgtccgcatcgccgcagtcggtgaaaaaaccgccgctgagatccgcgcgctcggcatcacgccggagcttctgcctgcacgtaccaggcaaaatgcgcaagggcttgtcgacgtgttccccgaatatttcgaagaactcgatccagtcggccgtgtcctcttgccgcgcgcagatatcgcaaccgacgtgcttgtcgacggcctgacccaccttggttgggaagtcgaagacgtggtggcttaccgcaccgtccgcgcagcaccaccaagcgctgatatccgagatatgatcaagaccggcggatttgatgcagttgccttcacctcttcgtcgaccgtgaagaacctcgttggtatcgcgggtaaaccacacccacgcaccatcgtcgcgtgcatcggacccatgactgcagcgaccgctgaagaactgggactgcgcgttgatgtcatgccagagatcgccgaagtaccagaactgatcgacgctcttgcggaacacgtggcggatctgcgcgctaagggcgagctgccgccgccgaggaagaaacgcaggcgtcgaaaagcgtcttaaaaggtttttcactagggtgt

SEQ ID NO: 820 - protein, 598 aa, Corynebacterium glutamicum
MTIAHKPEMAETTGIETNQVSETIGVESLTHGNLRPVSSFEGQHEGQTEELLPGKVIFVGAGPGNPDLLTVRAREVLGNAVRAITDEQVLSGVRAFVATEIPVPEDKLQAAEDEYERICIEAKENGARRKPPRPAPPTAAEITEVSEATPAQIVELVQDALSYGGDVIRLVTGNPLSSDATLAEISAVSEAGLEFQVVPGMSLPATVPAFAGIALGSTYTETDVNGQNLDWDQLASAPQPLVLQARVDDLSRIAQELKARNMSLETPVSVTANGTTRLQRTYDTTLGLLHKLDAELSGPLVVTLGKGVDDRSKYSWWENRALYGWRVLVPRAREQAASMSARLSSHGAIPQEVPTISVEPPRNPAQMERAIKGIVEGRYQWVVLTSVNAVKAVWEKITEFGLDSRSFAGVRIAAVGEKTAAEIRALGITPELLPARTRQNAQGLVDVFPEYFEELDPVGRVLLPRADIATDVLVDGLTHLGWEVEDVVAYRTVRAAPPSADIRDMIKTGGFDAVAFTSSSTVKNLVGIAGKPHPRTIVACIGPMTAATAEELGLRVDVMPEIAEVPELIDALAEHVADLRAKGELPPPRKKRRRRKAS

SEQ ID NO: 821 - DNA, 1024 bp, Corynebacterium glutamicum
  CDS (101)..(1024): FRXA00371
gtcgtggacaatcccggatcgaaaatttgattcggcttttttcatggctgttgatggagtacgttggtcgttttcgagacaagtactagaaaagatattgatgactatcgcccataagcccgagatggctgaaactaccgggatcgagaccaaccaggtttccgaaaccatcggggttgaatcgctcacgcacggaaacttacgtcctgtttcatcttttgagggacagcatgagggacaaacggaagagttacttccaggcaaagtcatttttgttggggccggtcccggtaaccctgatcttcttacagttcgtgcccgtgaagttctgggcaacgcggttcgtgcgattactgatgaacaagtactaagcggcgttcgagcttttgtcgccactgaaattcctgtgccggaagataagcttcaggctgcggaagatgagtacgagcgcatctgcattgaagcgaaggagaacggtgcacgccgtaagcctcctcgtccagcaccaccaaccgctgcagagatcacggaagtttctgaggcgactccagctcagattgttgagcttgtgcaggatgctctttcttatggtggagatgttattcgtcttgtcaccggcaacccattgagcagcgatgccacactggctgagatctctgcagtttccgaggctggcctggagttccaggtggttccaggtatgtctttgcctgcaacggttcctgcatttgcgggaattgcgttgggttctacctacaccgaaactgatgtcaacggtcaaaacttggactgggatcagttggctagcgcacctcagcctttggtgctgcaggcccgcgtggatgacctttcccgtattgcacaggaactaaaggcccgcaatatgtctttggaaactcctgtttctgtcaccgctaacggcaccacccgtttgcagcgcacctatgacaccactttaggtctgttgcacaagcttgatgctgaactaagcggacctttggttgttaccttgggcaagggtgtg

SEQ ID NO: 822 - protein, 308 aa, Corynebacterium glutamicum
MTIAHKPEMAETTGIETNQVSETIGVESLTHGNLRPVSSFEGQHEGQTEELLPGKVIFVGAGPGNPDLLTVRAREVLGNAVRAITDEQVLSGVRAFVATEIPVPEDKLQAAEDEYERICIEAKENGARRKPPRPAPPTAAEITEVSEATPAQIVELVQDALSYGGDVIRLVTGNPLSSDATLAEISAVSEAGLEFQVVPGMSLPATVPAFAGIALGSTYTETDVNGQNLDWDQLASAPQPLVLQARVDDLSRIAQELKARNMSLETPVSVTANGTTRLQRTYDTTLGLLHKLDAELSGPLVVTLGKGV

SEQ ID NO: 823 - DNA, 755 bp, Corynebacterium glutamicum
  CDS (1)..(732): FRXA00374
accatttctgtcgaaccaccgcgcaacccagcgcaaatggaacgcgccatcaagggcatcgtcgaaggacgctaccagtgggttgtcctcacaagcgtcaacgcagtgaaggcagtctggaagaaaatcaccgaattcggcctcgattcacgttccttcgcgggcgtccgcatcgccgcagtcggtgaaaaaaccgccgctgagatccgcgcgctcggcatcacgccggagcttctgcctgcacgtaccaggcaaaatgcgcaagggcttgtcgacgtgttccccgaatatttcgaagaactcgatccagtcggccgtgtcctcttgccgcgcgcagatatcgcaaccgacgtgcttgtcgacggcctgacccaccttggttgggaagtcgaagacgtggtggcttaccgcaccgtccgcgcagcaccaccaagcgctgatatccgagatatgatcaagaccggcggatttgatgcagttgccttcacctcttcgtcgaccgtgaagaacctcgttggtatcgcgggtaaaccacacccacgcaccatcgtcgcgtgcatcggacccatgactgcagcgaccgctgaagaactgggactgcgcgttgatgtcatgccagagatcgccgaagtaccagaactgatcgacgctcttgcggaacacgtggcggatctgcgcgctaagggcgagctgccgccgccgaggaagaaacgcaggcgtcgaaaagcgtcttaaaaggtttttcactagggtgt

SEQ ID NO: 824 - protein, 244 aa, Corynebacterium glutamicum
TISVEPPRNPAQMERAIKGIVEGRYQWVVLTSVNAVKAVWKKITEFGLDSRSFAGVRIAAVGEKTAAEIRALGITPELLPARTRQNAQGLVDVFPEYFEELDPVGRVLLPRADIATDVLVDGLTHLGWEVEDVVAYRTVRAAPPSADIRDMIKTGGFDAVAFTSSSTVKNLVGIAGKPHPRTIVACIGPMTAATAEELGLRVDVMPEIAEVPELIDALAEHVADLRAKGELPPPRKKRRRRKAS

SEQ ID NO: 825 - DNA, 1467 bp, Corynebacterium glutamicum
  CDS (101)..(1444): RXN00383
ccatatctttaaccttggtcatggtgtgcttcctaatacggtggcggaagatattactgaagccgtctccatcattcattcttaaactaagaggagtttcatgcgttttgccatcatcggtgcaggccttgcgggtctgactgctgcatatgagatccataaagctgatcccactgcccaaatcgatgtgttggaagcaggcgaacgcattggcggcaagctttttacggtgccgtttgcttccggacctaccgatattggagcggaggcgtttttagctgcgcgttccgatgcggtggagttttttactgagcttgggttggctgattctttggtcagcccgtctgctgcgaagtctcagtatttcgcgggcggtgcgctgcatgcgttccccgcaggtggagtgatgggtattccaagcaatccaccagcaggcgcgcaagacaccgcttttgattggactcctggccaagacatttctgttggcgccttagtgcgccgtcagtatggcgatgagatcgtcgatactgtggtgtcttcgctgcttggtggcgtttattcctccaccgctgatgatctgggtgtgcgcgcttccgtgccggcacttgctgcagcccttgatcagctggctgaggccggcgagccggtgactctgtcagctgcggtcaaggccgtggaagctcagcgggaagccgcaaaaacaacttcagaaacccgccccgttttccagaccttcaagggcggatacgcggagctgtacgaagcgttggcagagcaatgcggtgcagatattcacttggatagtttcgtttccgccatcaccaaagatggtgaaggttttgccatcaagggcggtggcgaaggcacctacgacaaggtgattttggcggttcccgctccaaccgccgctgtgctgctccgcgacttggcaccggccgcagcgccacatttgcgcgcaattaagttggcttcttcagcagtcgtcggcatgcgtttcgattccagcgagggcctgcccgacaactccggcgtcctggtcgctgttaatgagccgggcatcacggcgaaggccttcacgttctcctcaaagaagtggcctcacctggaggctcgcgggggcgcgctcgtgcgcgcgtcgttcggcaggctaggcgatgaggcgtcggcacgcatggacgaggatttgcttgtcgacgccgccctcgacgatctcctcaccataaccgggttcgacggccgggctgccggactgggtgaaattttcgtgcagcgctggttcggtgggctcccagcctatggagttgatcacattgctaccgtttcggctgcgcgtgcagagatcgcagccgtgcctggcgtggaagcaattggcgcgtgggctgggggagtgggagttcccgcagttatcgcagatgcccaggcagcagtacacaggttgctgggataagcacccaaaaacactattga

SEQ ID NO: 826 - protein, 448 aa, Corynebacterium glutamicum
MRFAIIGAGLAGLTAAYEIHKADPTAQIDVLEAGERIGGKLFTVPFASGPTDIGAEAFLAARSDAVEFFTELGLADSLVSPSAAKSQYFAGGALHAFPAGGVMGIPSNPPAGAQDTAFDWTPGQDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQCGADIHLDSFVSAITKDGEGFAIKGGGEGTYDKVILAVPAPTAAVLLRDLAPAAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIATVSAARAEIAAVPGVEAIGAWAGGVGVPAVIADAQAAVHRLLG

SEQ ID NO: 827 - DNA, 382 bp, Corynebacterium glutamicum
  CDS (101)..(382): FRXA00376
ccatatctttaaccttggtcatggtgtgcttcctaatacggtggcggaagatattactgaagccgtctccatcattcattcttaaactaagaggagtttcatgcgttttgccatcatcggtgcaggccttgcgggtctgactgctgcatatgagatccataaagctgatcccactgcccaaatcgatgtgttggaagcaggcgaacgcattggcggcaagctttttacggtgccgtttgcttccggacctaccgatattggagcggaggcgtttttagctgcgcgttccgatgcggtggagttttttactgagcttgggttggctgattctttggtcagcccgtctgctgcgaagtctcagtatttcgcgggcggtgcgctg

SEQ ID NO: 828 - protein, 94 aa, Corynebacterium glutamicum
MRFAIIGAGLAGLTAAYEIHKADPTAQIDVLEAGERIGGKLFTVPFASGPTDIGAEAFLAARSDAVEFFTELGLADSLVSPSAAKSQYFAGGAL

SEQ ID NO: 829 - DNA, 1037 bp, Corynebacterium glutamicum
  CDS (1)..(1014): FRXA00383
gcaggcgcgcaagacaccgcttttgattggactcctggccaagacatttctgttggcgccttagtgcgccgtcagtatggcgatgagatcgtcgatactgtggtgtcttcgctgcttggtggcgtttattcctccaccgctgatgatctgggtgtgcgcgcttccgtgccggcacttgctgcagcccttgatcagctggctgaggccggcgagccggtgactctgtcagctgcggtcaaggccgtggaagctcagcgggaagccgcaaaaacaacttcagaaacccgccccgttttccagaccttcaagggcggatacgcggagctgtacgaagcgttggcagagcaatgcggtgcagatattcacttggatagtttcgtttccgccatcaccaaagatggtgaaggttttgccatcaagggcggtggcgaaggcacctacgacaaggtgattttggcggttcccgctccaaccgccgctgtgctgctccgcgacttggcaccggccgcagcgccacatttgcgcgcaattaagttggcttcttcagcagtcgtcggcatgcgtttcgattccagcgagggcctgcccgacaactccggcgtcctggtcgctgttaatgagccgggcatcacggcgaaggccttcacgttctcctcaaagaagtggcctcacctggaggctcgcgggggcgcgctcgtgcgcgcgtcgttcggcaggctaggcgatgaggcgtcggcacgcatggacgaggatttgcttgtcgacgccgccctcgacgatctcctcaccataaccgggttcgacggccgggctgccggactgggtgaaattttcgtgcagcgctggttcggtgggctcccagcctatggagttgatcacattgctaccgtttcggctgcgcgtgcagagatcgcagccgtgcctggcgtggaagcaattggcgcgtgggctgggggagtgggagttcccgcagttatcgcagatgcccaggcagcagtacacaggttgctgggataagcacccaaaaacactattga

SEQ ID NO: 830 - protein, 338 aa, Corynebacterium glutamicum
AGAQDTAFDWTPGQDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQCGADIHLDSFVSAITKDGEGFAIKGGGEGTYDKVILAVPAPTAAVLLRDLAPAAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIATVSAARAEIAAVPGVEAIGAWAGGVGVPAVIADAQAAVHRLLG

SEQ ID NO: 831 - DNA, 873 bp, Corynebacterium glutamicum
  CDS (101)..(850): RXA01253
acgccatcgcagcctgccctcctggccgcatcgaagtcctcgccaactacaccgcattccgagacctcaaaaaggctctggagaaagggaccgaacaataatgaccaccctcaacatcggcctcatcctccccgacgtcctcggaacttacggcgacgacggcaacgcactagtcctgcgccaacgcgcacgcatgcgtggcattaatgctgaaatccagcgcgtcaccctcgacgacgccgtcccttccacccttgatctctactgcctcggcggcggcgaggacaccgcacagatccttgccaccgaacacctcaccaaagacggcggcctccaaaccgcagccgccgcaggccgccccatcttcgcagtctgcgcaggtctccaggtactcggcgactccttccgcgccgccggccgtgtcatcgacggccttgggcttatcgacgccaccaccgtctctttacaaaaacgcgccatcggagaagtcgaaacgacaccaacccgcgccggattcaccgccgagctgaccgaacgactcaccggcttcgaaaaccacatgggcgccaccctgctcggccccgacgccgaaccactcggccgagtcgtccgcggcgaaggcaacaccgatgtctgggcagcctccgaaaacaccgacgaccaacgccaacaattcgccgaaggcgccgtccaaggcagcatcatcgccacctacatgcacggccccgcactcgcccgaaacccccaactcgccgacctcatgctcgcaaaagcaatgggtgtcgcgctgaaagacctggagcctttggacatcgacgtcatcgaccgcctccgcgccgaacgcctggcgtagccccttctaaaccgggtcta

SEQ ID NO: 832 - protein, 250 aa, Corynebacterium glutamicum
MTTLNIGLILPDVLGTYGDDGNALVLRQRARMRGINAEIQRVTLDDAVPSTLDLYCLGGGEDTAQILATEHLTKDGGLQTAAAAGRPIFAVCAGLQVLGDSFRAAGRVIDGLGLIDATTVSLQKRAIGEVETTPTRAGFTAELTERLTGFENHMGATLLGPDAEPLGRVVRGEGNTDVWAASENTDDQRQQFAEGAVQGSIIATYMHGPALARNPQLADLMLAKAMGVALKDLEPLDIDVIDRLRAERLA

SEQ ID NO: 833 - DNA, 1044 bp, Corynebacterium glutamicum
  CDS (101)..(1021): RXA02134
tgatgaacgacatgtcgacattttcttccgccggcgtcgatggacccctaaacgcctcttccgaagcgcccgagcaaaacacggagtaactttctaagcgatgtccggcaaagcaggctttacccccgaagatcccgaagactcagacaaccgccacgggaacccccttttcgaaggtatctttaccgcacttaattggatgaccgttctccccgtccccggcgcatcagtttttgatcgcaccacgggcgcccgggtaatggcctctttgccctttgttggcttcgttttcggaatgttcaccgcgatcatcatgtgggctatcggccccatttcaggggtgatccacgtcgatggacttttagttgccgttctgatcgtcgcgttctgggaacttcttaatcggtttatgcacctcgacggcctcgcagatgtctccgatgctttgggttcctacgcagccccaccacgcgcacgagaaatccttgccgatccccgcaccggacttttcggcctcgccaccgccatgctttccgttctcctgcaggtcgctgcagtcgcatcgcttgtcgattcaaccgtgtggtggatgatctgcttcatccccgttctcggccgcatcgctggacaagtaaccgcactgaaaaaccacaacgccttctcccccaccggctttggcgcactagtcatcggaacggtgaaattttggtggatcgcgctgtggctcttggttactgctgcgttggctttttggtgcgcagaattaatttctccactttcaccgctgaccagtgttaacactccctttgtcgctggacctttccccgctgcaatcaaccccgcctggcttggaggctgggttgcgataaccgcagtcgtggcatgtgttttcgcagcacttttcagccgccgcttatcacgaagtttcggtggactcaacggagactgcatcggcgcatgcattcatctcggggcgtcgatttctgcagtgatgtttgctgttgtcgccaatgcaatggtgtaaagcggtggcgtcttttggga

SEQ ID NO: 834 - protein, 307 aa, Corynebacterium glutamicum
MSGKAGFTPEDPEDSDNRHGNPLFEGIFTALNWMTVLPVPGASVFDRTTGARVMASLPFVGFVFGMFTAIIMWAIGPISGVIHVDGLLVAVLIVAFWELLNRFMHLDGLADVSDALGSYAAPPRAREILADPRTGLFGLATAMLSVLLQVAAVASLVDSTVWWMICFIPVLGRIAGQVTALKNHNAFSPTGFGALVIGTVKFWWIALWLLVTAALAFWCAELISPLSPLTSVNTPFVAGPFPAAINPAWLGGWVAITAVVACVFAALFSRRLSRSFGGLNGDCIGACIHLGASISAVMFAVVANAMV

SEQ ID NO: 835 - DNA, 1197 bp, Corynebacterium glutamicum; identical to SEQ ID NO: 571
  CDS (101)..(1174): RXA02135

SEQ ID NO: 836 - protein, 358 aa, Corynebacterium glutamicum; identical to SEQ ID NO: 572

SEQ ID NO: 837 - DNA, 645 bp, Corynebacterium glutamicum
  CDS (101)..(622): RXA02136
tggttttggtctgggttactacgcgtattcccgcaccattcagcctcgtaagtggcgtacccctcgtgcacgcgttgaaattggtgctgaagtctagcgcatgcgcacgttagttcttggcggggccaggtctggtaagtctgcttttgcagaatcacttgttggatctggtcccgttttgtatgtcgcaacggcaaggccttcgggagatgatcctgaattcgccgagcgcattgcggttcatgcggagcggcgcccaacgtcttgggtgttggacgaggagggggacgtcgataagcttcttgcctcgccaccggccatgccggtgctcgttgatgacctgggcacctggctcacgcacgccaccgatgcgtgcgacggttgggaggcgagttcggcgcagcttgaggccaagatggatttgcttatcgacgccatcctccactttcagggcgaagatctggtaattgtttcacctgaagttggtatgggaatcgtcccggaatataaatctgggcgcctttttcgtgatcgcatcggcacacttaatcagcgtgtcgcagcgatttgcgagagggttgtcttcgtggttgctggtctgccactagagttgaaaacgttttaagaaaacagtcggtttgaagg

SEQ ID NO: 838 - protein, 174 aa, Corynebacterium glutamicum
MRTLVLGGARSGKSAFAESLVGSGPVLYVATARPSGDDPEFAERIAVHAERRPTSWVLDEEGDVDKLLASPPAMPVLVDDLGTWLTHATDACDGWEASSAQLEAKMDLLIDAILHFQGEDLVIVSPEVGMGIVPEYKSGRLFRDRIGTLNQRVAAICERVVFVVAGLPLELKTF

SEQ ID NO: 839 - DNA, 575 bp, Corynebacterium glutamicum
  CDS (1)..(552): RXN03114
actccggggcattttgttgcgctcgcgcgggagattgcgggcgcggtgcgccgcgagttgacggtggggttggatgctggtgacggtccgattttaaggcagagctttgatgttggttttttgcttgtcgacgcctccttccacattcatatcaatggcgtgtctactgggcagtcggttgcgccggatgatgtagttgaggtggtgcgtggtttggctgatgcttcggagttgtccgtggaaagtgttgctgagttgtgtactcccgtggcaccggtttcattatctgaggcacaggggaatcctgcgcctattgggtggttggagcatgatggcgtggtgtcgttgggtgcgggtattccaggggggcgggtggaggctcgtttagcgcgttttattgcggtgattgaggcggagaccactattaccccatggaattcgttgatcattcatgatttgtatgagggtgttgcagaacaggtggtgaaggttctggctcccatggggttggtttttgatgctaattcaccgcttctggagtcaccggctttgtaactcgccattggtgcacgtct

SEQ ID NO: 840 - protein, 184 aa, Corynebacterium glutamicum
TPGHFVALAREIAGAVRRELTVGLDAGDGPILRQSFDVGFLLVDASFHIHINGVSTGQSVAPDDVVEVVRGLADASELSVESVAELCTPVAPVSLSEAQGNPAPIGWLEHDGVVSLGAGIPGGRVEARLARFIAVIEAETTITPWNSLIIHDLYEGVAEQVVKVLAPMGLVFDANSPLLESPAL

SEQ ID NO: 841 - DNA, 1200 bp, Corynebacterium glutamicum
  CDS (101)..(1177): RXN01810
ccaccaccacaatgttgctcatcctcgcggcgttcgttgtcgcaggtggctccatgactcgcttcaccgtcggcaacccgactggaaaataaggcttcacatgaataacgcttttcgacgcacccttacatccgtagtcctcgccgctagcttggccttaacggcctgcgcaagctgggattcacctacggcatcttccaatggtgatctgattgaggagatccaggcaagctccacctcaacagatccgcgcaccttcacaggcttgagcatcgtggaagatatcggcgatgtggttcccgtaaccgacaacgcctcaccagctctgccagtttctttgaccgacgctgatggcaacgacgtggtggtggagaacgtgtcccgcatcctcccactggatctctacggaacctattccaaaaccatcgctggcctgggactcgtggacaatattgtgggtcgtactgttagttccaccgagcctgcattggcggacattgaggtggtcaccactggcggacacaccctcaatgctgaagcgatccttaatttacatccgactttggtgatcatcgaccactcgatcggcccacgcgaagtcatcgatcagatccgcgcagctggtgtcgccacggtgatcatgtcgccgcagcgttccattgcctcaattggcgacgacatccgcgacatcgcctccgtcgttggacttcctgaagaaggggagaagctcgcggaacgttccgttgctgaagtcgaagaggccagcacggttgtcgatgaactcaccccagaagatcccctcaaaatggtattcctctatgcccgcggaactggtggagtgttcttcattttgggcgatgcctatggtggacgcgatctcattgaaggcctgggcggcgtcgacatggctgctgaaaagggcatcatggatctggcaccagccaacgcggaagcacttgccgaactaaatccagacgtcttcgtgatgatgtcggaaggactagtctcgacaggaggtatcgacggtcttatggaacgccccggcattgctcagacaaccgccggacaaaaccaacgagtactggcgcttcccgatggtcaatcattggcctttggtgcccaaactggcgagttgttgctccgcgcatcccgcgaactgtatgtgcagggcggcgagtagatggttgtgaaggaggttga

SEQ ID NO: 842 - protein, 359 aa, Corynebacterium glutamicum
MNNAFRRTLTSVVLAASLALTACASWDSPTASSNGDLIEEIQASSTSTDPRTFTGLSIVEDIGDVVPVTDNASPALPVSLTDADGNDVVVENVSRILPLDLYGTYSKTIAGLGLVDNIVGRTVSSTEPALADIEVVTTGGHTLNAEAILNLHPTLVIIDHSIGPREVIDQIRAAGVATVIMSPQRSIASIGDDIRDIASVVGLPEEGEKLAERSVAEVEEASTVVDELTPEDPLKMVFLYARGTGGVFFILGDAYGGRDLIEGLGGVDMAAEKGIMDLAPANAEALAELNPDVFVMMSEGLVSTGGIDGLMERPGIAQTTAGQNQRVLALPDGQSLAFGAQTGELLLRASRELYVQGGE

SEQ ID NO: 843 - DNA, 963 bp, Corynebacterium glutamicum
  CDS (1)..(933): RXS03205
gattccggcattcccacgcagttggtggagggcagctggtttgaaccggttcgcgggcgcacctttgaccgcatcatcgccaacccgccgttcgtggtgggaccaccggaaattgggcatgtgtaccgcgattccggcatggatctagacggcgcgaccgcgttggtggtcaaagaagcctgcgcgcatctcaaccctggtggcaccgctcacctgctcggcgcatgggtgcattccgcggatcaatcgtggcagcagcgcgttgcagaatggttgccggataacggttatgttgcttgggttattgagcgcgacgccgtgagccccgcgcagtatgtgggcacgtggcttagtgatgagtccctcgatctgcgtagccccgaggcagcagcacgcaccaccgcgtggcttaaccactttgaaaaagccaaggttcaaggcgttggttttggtttcatcgccatccaacgtctggaggaagacgaggcggatgagaaatccgatatcttggctgaatccatgacccagtacttcgaggatcctctcggccctgaaattgaggagtacttcacccgcaccgcatggcttcgtgaacaaactcgcgattccattctgagctcccgcttcaaagttcgccctggcgtggcccgggaacaaatcagcctggccgatgcggaagaaggcatgggctttagtcctgtcacgttgaggctcacccgcaccgatggtcctcgttggtcccatgatgttgatgagcatgtggcttccatcgtcgcaggacttaacccacatggactcccctttgaagaaatcctggaaatgtacgcgatggctcaaggtatcgagggagaatccctgcacaacggcgccattgcggcgttggtggatctcatccgccacggattggtgttgcccgctgatcttctcgattcttaaataaggactgattgtgaaagccgtttt

SEQ ID NO: 844 - protein, 311 aa, Corynebacterium glutamicum; identical to SEQ ID NO: 800

SEQ ID NO: 845 - DNA, 956 bp, Corynebacterium glutamicum; identical to SEQ ID NO: 799
  CDS (1)..(933): FRXA00306

SEQ ID NO: 846 - protein, 311 aa, Corynebacterium glutamicum; identical to SEQ ID NO: 800

SEQ ID NO: 847 - DNA, 819 bp, Corynebacterium glutamicum
  CDS (101)..(796): RXC01715
acatgttgttggaacatgccggcagagccgacactacgattcattcgctaaagggtctggccactgacactggcaaagatccacgaaaggaagttaccctgtgagcgagctcgatattaaacagctcaacaaactgcagcgctactctcagtgggcggtgttccgtgctattcctggagcgctcgatgatgatcgcacagaagtcactgaccaagcagccaagttctttgccgaccttgaagcagaaggcaaagtcactgtccgtggcatttacaacgcctccggcctgcgcgcagacgctgactacatgatctggtggcacgcagaagaattcgaagacattcagaaggccttcgctgatttccgccgcaccaccattttgggtcaggtttctgaggtcttctggatcggaaacgctctccaccgtccatctgagttcaacaaggctcacttgccttcattcatcatgggtgaagaagcaaaggactggatcactgtttacccgttcgtgcgcagctacgactggtacatcatggagcccttgaagcgttcccgcattctccgcgagcacggacaagctgctgtggaattcccagatgttcgtgccaacactgtgccggctttcgcactgggtgactacgaatgggtgctggctttcgaggctgatgagttgcaccgcattgtcgatttgatgcacaagatgcgttacaccgaggctcgcctccacgtccgtgaggagctgccatttatttctggacagcgcgtcgacattgcagatctgattaaggttcttccttaaaagctgcttttctaaacgat

SEQ ID NO: 848 - protein, 232 aa, Corynebacterium glutamicum
VSELDIKQLNKLQRYSQWAVFRAIPGALDDDRTEVTDQAAKFFADLEAEGKVTVRGIYNASGLRADADYMIWWHAEEFEDIQKAFADFRRTTILGQVSEVFWIGNALHRPSEFNKAHLPSFIMGEEAKDWITVYPFVRSYDWYIMEPLKRSRILREHGQAAVEFPDVRANTVPAFALGDYEWVLAFEADELHRIVDLMHKMRYTEARLHVREELPFISGQRVDIADLIKVLP

SEQ ID NO: 849 - DNA, 1587 bp, Corynebacterium glutamicum
  CDS (101)..(1564): RXN00420
attcgtgaactcatggatctttaggcaataaatgtgagattggacgatttcacgcttgtcttcaccacctgaaaattttcgggggtaacctttaaaggcgatgaacagttctcacggcacgtccagctccggcgcttcggccggtgcccacggagcccttcccctagaagctcagaaactgaacggttggggccgcacagcccccaccaccgctgaggtacttaccaccccagacctagacatcattgtggatgcagtccgccaagtcgctgaacaaaacgactccaagccggactacctcaagcgcggcgtgattgcccgtggcatgggtcgttcctatggtgacccagcccaaaacgccggtggccttgtcattgacatgcagccactgaacaaaatccactcgattgatcctgattctgcgatcgtcgatgtagatggcggcgtcaccctcgatcagctcatgaaggctgccctgccatatggcctctgggttcctgtccttcccggcacccgccaagtcaccatcggtggcgcaatcggaccagacatccacggtaagaaccaccactctgcaggttccttcggcgaccacgtggtctccatggaactcctcgttgcagacggacgcatcctgcacctcgagccagaaggcaccgccgaagacccacagggcgacctgttctgggcaaccgttggtggcatgggcctgaccggcatcatcgtccgtgcacgcatccgcatgaccaagacggaaaccgcctacttcattgcggacaccgaccgcaccaacaacttggaagaaaccgttgcgttccactccgacggatcagagcacaactacacctattcttctgcgtggttcgatgtcatcagccctgagccaaagcttggccgctccaccatctcccgtggttccctggcaacacttgctcagctggaagaattggcaccaaagctggccaaggatccactgaagtttaatgctccacagctgatgaaggttccagatatcttcccatcctggactttgaacaagctgaccctttccgcagtcggtgtggcttactacgccatgggtgcaccagcgaaaaaccaggtgaaaaacctcacccagttctaccaaccactggatttgatcggcgaatggaaccgtggctacggctccaagggcttcctgcagtaccagttcgtggtccccacagaagctgttgagcctttcaaggacatcatccgcgatatgcaaaagtccggccactactccgcactcaacgtgttcaaactgtttggcccaggcaaccgcgcaccactgtcctacccaatgccaggctggaacgtctgcgttgacttccctatccgcccaggtctgggagctttcttggacgatctggacaagcgcgtcatggaattcggcggccgcctctacctggccaaggaatcccgcacctccgcagagaacttccacgccatgtacccaggtatggaaggctggttgaagactcgaaatgagatcgacccaaccggagtctttgcatctgacatgtcccgccgacttgagctttcttaagaaagggcttgaactaaaca

SEQ ID NO: 850 - protein, 488 aa, Corynebacterium glutamicum
MNSSHGTSSSGASAGAHGALPLEAQKLNGWGRTAPTTAEVLTTPDLDIIVDAVRQVAEQNDSKPDYLKRGVIARGMGRSYGDPAQNAGGLVIDMQPLNKIHSIDPDSAIVDVDGGVTLDQLMKAALPYGLWVPVLPGTRQVTIGGAIGPDIHGKNHHSAGSFGDHVVSMELLVADGRILHLEPEGTAEDPQGDLFWATVGGMGLTGIIVRARIRMTKTETAYFIADTDRTNNLEETVAFHSDGSEHNYTYSSAWFDVISPEPKLGRSTISRGSLATLAQLEELAPKLAKDPLKFNAPQLMKVPDIFPSWTLNKLTLSAVGVAYYAMGAPAKNQVKNLTQFYQPLDLIGEWNRGYGSKGFLQYQFVVPTEAVEPFKDIIRDMQKSGHYSALNVFKLFGPGNRAPLSYPMPGWNVCVDFPIRPGLGAFLDDLDKRVMEFGGRLYLAKESRTSAENFHAMYPGMEGWLKTRNEIDPTGVFASDMSRRLELS

SEQ ID NO: 851 - DNA, 563 bp, Corynebacterium glutamicum
  CDS (1)..(540): FRXA00420
tggactttgaacaagctgaccctttccgcagtcggtgtggcttactacgccatgggtgcaccagcgaaaaaccaggtgaaaaacctcacccagttctaccaaccactggatttgatcggcgaatggaaccgtggctacggctccaagggcttcctgcagtaccagttcgtggtccccacagaagctgttgagcctttcaaggacatcatccgcgatatgcaaaagtccggccactactccgcactcaacgtgttcaaactgtttggcccaggcaaccgcgcaccactgtcctacccaatgccaggctggaacgtctgcgttgacttccctatccgcccaggtctgggagctttcttggacgatctggacaagcgcgtcatggaattcggcggccgcctctacctggccaaggaatcccgcacctccgcagagaacttccacgccatgtacccaggtatggaaggctggttgaagactcgaaatgagatcgacccaaccggagtctttgcatctgacatgtcccgccgacttgagctttcttaagaaagggcttgaactaaaca

SEQ ID NO: 852 - protein, 180 aa, Corynebacterium glutamicum
WTLNKLTLSAVGVAYYAMGAPAKNQVKNLTQFYQPLDLIGEWNRGYGSKGFLQYQFVVPTEAVEPFKDIIRDMQKSGHYSALNVFKLFGPGNRAPLSYPMPGWNVCVDFPIRPGLGAFLDDLDKRVMEFGGRLYLAKESRTSAENFHAMYPGMEGWLKTRNEIDPTGVFASDMSRRLELS

SEQ ID NO: 853 - DNA, 622 bp, Corynebacterium glutamicum
  CDS (101)..(622): FRXA00426
attcgtgaactcatggatctttaggcaataaatgtgagattggacgatttcacgcttgtcttcaccacctgaaaattttcgggggtaacctttaaaggcgatgaacagttctcacggcacgtccagctccggcgcttcggccggtgcccacggagcccttcccctagaagctcagaaactgaacggttggggccgcacagcccccaccaccgctgaggtacttaccaccccagacctagacatcattgtggatgcagtccgccaagtcgctgaacaaaacgactccaagccggactacctcaagcgcggcgtgattgcccgtggcatgggtcgttcctatggtgacccagcccaaaacgccggtggccttgtcattgacatgcagccactgaacaaaatccactcgattgatcctgattctgcgatcgtcgatgtagatggcggcgtcaccctcgatcagctcatgaaggctgccctgccatatggcctctgggttcctgtccttcccggcacccgccaagtcaccatcggtggcgcaatcggaccagacatccacggtaagaaccaccactctgcaggttccttcggcgaccacgtggtctccatggaactcctcgttgca

SEQ ID NO: 854 - protein, 174 aa, Corynebacterium glutamicum
MNSSHGTSSSGASAGAHGALPLEAQKLNGWGRTAPTTAEVLTTPDLDIIVDAVRQVAEQNDSKPDYLKRGVIARGMGRSYGDPAQNAGGLVIDMQPLNKIHSIDPDSAIVDVDGGVTLDQLMKAALPYGLWVPVLPGTRQVTIGGAIGPDIHGKNHHSAGSFGDHVVSMELLVA

SEQ ID NO: 855 - DNA, 930 bp, Corynebacterium glutamicum
  CDS (101)..(907): RXN00708
cctgcgtatcggctgcctttttgaattcttttcctcctcgaggcctaaccttcaattccttaccgatccccttccctgaagtttcgctaacctggcgtacatgactctttcccttcctccaattggtttcggcaccgttcatcttgatggcgcacctggcgttgaagccatcgctactgccattgatgctggttaccgcctcatcgacaccgcgtacaactatgaaaatgaaggtaccgtgggcaaggctgtccgcgagtcgggtgtcccccgcgaggaattgattgttaccagtaagctccctggccgcttccatgctcgcgatctaggacgcgtccgcattgaggaaagtctataccgcctcaacttagattacatcgatctcctcttgattcactggcctaatcccagcaaggatctctacgtcgaggcgtgggaaacgctgattgaagtccgcgatgctggcctggtcaagcacatcggagtgtctaacttccttccaaatcacattgatcgcctgcgccgcgaaaccggtgaactgccggccgttaaccagatcgagttgcacccctatttcccgcaggtggagcaggtagatttccacgatgagctgggcatcattaccgaggcctggagcccgctcagcaacggtcgcggactcgtcgaagagccattgctcaaggaaatcggcgagcgctacggggtcggcagcggcgaaatcgccctcgcttggcatcacgccaggggaatcgttccgattccacgctccaccaacccggccaggcagcgcagcaacttggaggcggtaaagatttcgcttatcgacgaagacgtccaggcgattaccgctttggcgcgcaaaaacggccggatcaaagatcaagatccagccgtctatgaagaattctagatagttacatcaaggttccg

SEQ ID NO: 856 - protein, 269 aa, Corynebacterium glutamicum
MTLSLPPIGFGTVHLDGAPGVEAIATAIDAGYRLIDTAYNYENEGTVGKAVRESGVPREELIVTSKLPGRFHARDLGRVRIEESLYRLNLDYIDLLLIHWPNPSKDLYVEAWETLIEVRDAGLVKHIGVSNFLPNHIDRLRRETGELPAVNQIELHPYFPQVEQVDFHDELGIITEAWSPLSNGRGLVEEPLLKEIGERYGVGSGEIALAWHHARGIVPIPRSTNPARQRSNLEAVKISLIDEDVQAITALARKNGRIKDQDPAVYEEF

SEQ ID NO: 857 - DNA, 695 bp, Corynebacterium glutamicum
  CDS (1)..(672): FRXA00708
accgtgggcaaggctgtccgcgagtcgggtgtcccccgcgaggaattgattgttaccagtaagctccctggccgcttccatgctcgcgatctaggacgcgtccgcattgaggaaagtctataccgcctcaacttagattacatcgatctcctcttgattcactggcctaatcccagcaaggatctctacgtcgaggcgtgggaaacgctgattgaagtccgcgatgctggcctggtcaagcacatcggagtgtctaacttccttccaaatcacattgatcgcctgcgccgcgaaaccggtgaactgccggccgttaaccagatcgagttgcacccctatttcccgcaggtggagcaggtagatttccacgatgagctgggcatcattaccgaggcctggagcccgctcagcaacggtcgcggactcgtcgaagagccattgctcaaggaaatcggcgagcgctacggggtcggcagcggcgaaatcgccctcgcttggcatcacgccaggggaatcgttccgattccacgctccaccaacccggccaggcagcgcagcaacttggaggcggtaaagatttcgcttatcgacgaagacgtccaggcgattaccgctttggcgcgcaaaaacggccggatcaaagatcaagatccagccgtctatgaagaattctagatagttacatcaaggttccg

SEQ ID NO: 858 - protein, 224 aa, Corynebacterium glutamicum
TVGKAVRESGVPREELIVTSKLPGRFHARDLGRVRIEESLYRLNLDYIDLLLIHWPNPSKDLYVEAWETLIEVRDAGLVKHIGVSNFLPNHIDRLRRETGELPAVNQIELHPYFPQVEQVDFHDELGIITEAWSPLSNGRGLVEEPLLKEIGERYGVGSGEIALAWHHARGIVPIPRSTNPARQRSNLEAVKISLIDEDVQAITALARKNGRIKDQDPAVYEEF

SEQ ID NO: 859 - DNA, 1038 bp, Corynebacterium glutamicum
  CDS (101)..(1015): RXA02373
aaagtcatagctcatggtaattcagtgtagataggcgtacggtgggctatccaattcatctcaacctaaggcgcattttggtgcgcatcaaggagaaaatatgtctgttgtgggtaccggcctattctttggatccccggaggaagagcgggataagttgatgcaatctttgatggatcagaagaataagctttcgaagtctgaaggtatcccattggtcaccttgaatgatggaaaaaccattcctcagcttggttttggtgtgttcaaggtagatcccgatgaagcagagcgcgtagttaccgaagcacttgaggtaggttaccgccacatcgatactgctgcgatttacggcaatgaggaaggtgtcggccgagctattgctaagtccggcattcctcgtgaagagctgtttattactaccaagttgtggaacgatcgccacctggatgtagaagctgcttttgaggagtctctgcagaagctgggcttggattatgtagatctgtacttggtgcactggccggcaccgaagaacgataattatgttgctgcatggaagggcttggaaaagctcggtgaccgtgctcgttccatcggtgtgtgcaacttcctgccagagcacctagaaaagctgctggcagaggcaaccactgtgcctgccattaaccagattgagctgcacccagctttgcagcagcgcgatgctgttgaggcatctcttgcagcaggcatcactgtggagtcgtggggtcctctgggacaggggcgttttgatcttggcgctgaggaaccaatcgcagctgcagcgaagaaccatggaaagaccccagctcaggttgttatccgttggcacctgcagaacggtttcgttgtgttccccaagactgtgactaagagccgcatggtggaaaacatcgacgtgtttgatttcgaactcagtgatgaggagatggctgcgatcactgctcttgagcgcaatgatcgtggtggttcacacccgaatgatctgaactagaaataaggtaaggccctgca

SEQ ID NO: 860 - protein, 305 aa, Corynebacterium glutamicum
MSVVGTGLFFGSPEEERDKLMQSLMDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 861 - DNA, 1683 bp, Corynebacterium glutamicum
  CDS (101)..(1660): RXS00389
ccaccactgcgtaacctttccgagcaagatatcgcggacctgtcggatttgcttgccacctctggcgcaggttcctaccgccttcagttgaggtgaaagcatgatcaccgcaaccgcactgcatgggtgttcactgattgatggcgagtgggtcgctggaaaaaatggtgagattacaggattcgatccgcgcaccaatgcgagtctgaacccttcctactctttagcaaacagcgcacagctgcgcgccgccacaacatcggcgaagcgagcttttgaaagctaccgactcactactccagaggttagagcagatttcctggattccatcgctgacaacatcgatgcgctatccggcgagatcgtgcaacgggcgagcctggagacaggtttgggaactacccgactcacaggcgaagtagcccgcaccagcaaccagctccgcctgtttgcagaaaccgtgagaagcggacagttccaccgagtacgcattgaacgaggaccgcggattgatcttcgccagcgtcaggttccgttgggaccagtcgcggtattcggggcaagcaacttccccgtcgctttctctactgctggtggcgatacagcatcagcgttggctgcaggctgccctgtggtttttaaggcgcataatgcgcaccctggaacagctgagctcgtcgggcaagcggtgcggggagccgtcgaaaagcatgagtttgatgctggtgtgtttaaccttgtctacggccgtggcgtggaaattggccaggagctggctgcggatccgaatatcacggcaatcggttttaccggttcacgccagggtggtttggcactgtcacagactgcgtttagccgcccagttcccgttccagtctttgcagaaatgagtgccaccaaccctgtgttcgtcttccccggcgcgctggcggatttggatgcatcgagttccttggctgaggcgtttaccgcttccgtcaccggcagttccgggcaattgtgcaccaagcctggcctcgttttcatcccgcgcggtgttgttggtgatgcttttgtggcgctcgtagcagccaaatttaaagaaaccacgggtcaaacgatgctcacgcaaggcatcgctcaggcatggcagcgcggagtcgacaaccttgcagcacagccaagtgtaaaaatcctcgcccaaggcacccccggagatggagagaacgcgccgggcccggtggtgtttgaaagtgatgtgcaggcgttgctaaataatgtggtgttgcaggaagaaatcttcggtgcggcatcgctggtggtgcgttatgattccccggatcaactccaccaagtagccaattcactcgagggacaattaacagccacgatccacgcatcccaggatgatttccaggaagtctcgaaacttatccccctcttggaggatctcgcgggccgtgttctttacggcggctggccaacgggtgtggaagttgggcacacggttatccatggaggcccttatccggcgacctcaaatgcgcagtcgacaagtgttggaaccctggcaatcgagagatttatgcgcccggtttcttatcaaactttcccggctgagctgcttccagatccagtttctgaggcgaataaatgggctgtacctcgggaaatagaccgttaatagctggtctttacatttgc

SEQ ID NO: 862 - protein, 520 aa, Corynebacterium glutamicum
MITATALHGCSLIDGEWVAGKNGEITGFDPRTNASLNPSYSLANSAQLRAATTSAKRAFESYRLTTPEVRADFLDSIADNIDALSGEIVQRASLETGLGTTRLTGEVARTSNQLRLFAETVRSGQFHRVRIERGPRIDLRQRQVPLGPVAVFGASNFPVAFSTAGGDTASALAAGCPVVFKAHNAHPGTAELVGQAVRGAVEKHEFDAGVFNLVYGRGVEIGQELAADPNITAIGFTGSRQGGLALSQTAFSRPVPVPVFAEMSATNPVFVFPGALADLDASSSLAEAFTASVTGSSGQLCTKPGLVFIPRGVVGDAFVALVAAKFKETTGQTMLTQGIAQAWQRGVDNLAAQPSVKILAQGTPGDGENAPGPVVFESDVQALLNNVVLQEEIFGAASLVVRYDSPDQLHQVANSLEGQLTATIHASQDDFQEVSKLIPLLEDLAGRVLYGGWPTGVEVGHTVIHGGPYPATSNAQSTSVGTLAIERFMRPVSYQTFPAELLPDPVSEANKWAVPREIDR

SEQ ID NO: 863 - DNA, 882 bp, Corynebacterium glutamicum
  CDS (101)..(859): RXS00419
gctggttgaagactcgaaatgagatcgacccaaccggagtctttgcatctgacatgtcccgccgacttgagctttcttaagaaagggcttgaactaaacaatgcttaacgcagtgggcaaagcccaaaacattctccttcttggtggaacctctgagatcggtatttccattgtctcccgcttcctcaagcagggtccatcccatgtgaccttggcagcgcgtaaagattccccacgcgtggacgcagcagtcgcagagatcaaagcagctggcgctgcttccgttgctgttgttgatttcgatgcgctcgacaccgaatcccaccctgcagccatcgacgcagcctttgaaaacggcgacgttgacgtagcaatcgtggctttcggcatcctcggcgacaacgaagcacagtggcgcgaccaagcactagcagtggaagcaaccaccgtgaactacaccgccggcgtttccgtaggtgtactgctgggccagaaatttgagcagcagggccacggcaccatcgtggcattgtcctctgtggcaggccagcgagtccgccgctccaactttgtctacggctccgccaaggcaggtttcgacggtttctacacccagctcggcgaagccctgcgtggatccggtgccaacgtattggtggttcgcccaggccaggtacgcaccaagatgtccgcagatggtggcgaagccccactgaccgtcaaccgcgaagacgtggcagatgctgtttatgatgcagtggtgaacaagaaggacatcatctttgtccacccactgttccagtacgtctcttttgcgttccaattcattccgcgagcaatcttccgcaagctgccgttctaacggaagttacggaagttacg

SEQ ID NO: 864 - protein, 253 aa, Corynebacterium glutamicum
MLNAVGKAQNILLLGGTSEIGISIVSRFLKQGPSHVTLAARKDSPRVDAAVAEIKAAGAASVAVVDFDALDTESHPAAIDAAFENGDVDVAIVAFGILGDNEAQWRDQALAVEATTVNYTAGVSVGVLLGQKFEQQGHGTIVALSSVAGQRVRRSNFVYGSAKAGFDGFYTQLGEALRGSGANVLVVRPGQVRTKMSADGGEAPLTVNREDVADAVYDAVVNKKDIIFVHPLFQYVSFAFQFIPRAIFRKLPF

SEQ ID NO: 865 - DNA, 1673 bp, Corynebacterium glutamicum
  CDS (1)..(1650): RXC00416
ctggcgtcttacttaagcccaactgcgctggtggttgcggtgttggctattccgctgtctgcgacccgcctgtatttggacggaatcagcgttgaccagggctttagaactcagtttttaacccgcatggctgacgatatcggcttgtcggacatgaactacatcgatatgcctaccttctaccctgctggatggttctggctcggtggtcgcttggccaatcttttggggctgcccggttgggaagctttccagccatgggcaattgtgtccatggcagttgctgcttctgtgttagttccagtgtggcagcgcatcaccggttccctgccggtggcaacaggcattgcgttggtgacaacctgcattatcttggcgatgaattccgaagagccctacgctgcaatcgttgcgatgggtattccagcgatgctcgtgctggcttcccgcattgccaagggcgataagtttgcgcttgccggcggcattatttacttgggtgtttcggctactttctatactttgttcaccggtgctatcgcgctttctgcggtcgcggtgtgcatcgtggtggcggctattgtgcagcgctccatcaaaccactgctgtggcttgcagtgctgggtggtggatccattgtcattgcgttgatttcttggggtccttaccttctggcctccatcaacggagcggagcgctctggcgattccgcaacacactacctgcctcttgaaggcacccaattcccggttcctttcttggcatcaagcgttgtgggactgttgtgtcttgttggcctgatctatttggtggtgcgtttccacaacaatgaggtgcgcgcgatgtgggtcggcatcgcagtgttttatgcctggatgggcatgtccatggcgatcacgcttttgggcaacacgttgcttggattccgtcttgatacggtgctggtgcttatttttgccacggctggagtgttgggcattgcagatttccgccttgccagtgtgtatcagctctaccccacccaaatcacagagcgcacggccacccatctgaccaatctaattgtggtcctcgtgctgcttggcggcctctactacgcgcaagatctgccgcagaagaacgcacgagctatcgatctggcctataccgatactgatggctacggcgagcgcgcggatctgtatccggccggagctgcacgttattacaaggacatcaacgatcatctgcttgatcaaggattcgagccttccgaaactgtcgtgctgacagacgaactcgatttcatgtcctactacccttatcgcggataccaagcttttacttcccactacgccaacccgcttggtgagttcggaaacaggaacgcattcatcgaagatctcgcgatccgaagctgggatgagttggctgatcctcaacaattcagcgacgccttgaacacctctccatggacgatccctgaggtgttcatcttccgtggctccatcgatgatcctgacgccggttggaaatacgacgtggctgaagatctgtacccgaacaatccaaacgtgcgcttccgcggcgtgtactttaacccggagtcatttgatcagatgtggcagaccaagcaagtgggacctttcgtggtggtaacgcacaatgagtaattcctcaccaaacgacccaa

SEQ ID NO: 866 - protein, 550 aa, Corynebacterium glutamicum
LASYLSPTALVVAVLAIPLSATRLYLDGISVDQGFRTQFLTRMADDIGLSDMNYIDMPTFYPAGWFWLGGRLANLLGLPGWEAFQPWAIVSMAVAASVLVPVWQRITGSLPVATGIALVTTCIILAMNSEEPYAAIVAMGIPAMLVLASRIAKGDKFALAGGIIYLGVSATFYTLFTGAIALSAVAVCIVVAAIVQRSIKPLLWLAVLGGGSIVIALISWGPYLLASINGAERSGDSATHYLPLEGTQFPVPFLASSVVGLLCLVGLIYLVVRFHNNEVRAMWVGIAVFYAWMGMSMAITLLGNTLLGFRLDTVLVLIFATAGVLGIADFRLASVYQLYPTQITERTATHLTNLIVVLVLLGGLYYAQDLPQKNARAIDLAYTDTDGYGERADLYPAGAARYYKDINDHLLDQGFEPSETVVLTDELDFMSYYPYRGYQAFTSHYANPLGEFGNRNAFIEDLAIRSWDELADPQQFSDALNTSPWTIPEVFIFRGSIDDPDAGWKYDVAEDLYPNNPNVRFRGVYFNPESFDQMWQTKQVGPFVVVTHNE

SEQ ID NO: 867 - DNA, 1059 bp, Corynebacterium glutamicum
  CDS (101)..(1036): RXC02206
ggcaggatctgctgctgcggctaggagggttatctcttcattcacccgatctaccgtactaccttatgacctcagtagtgtggtgggcgtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctgtgacttggtccaattacattcac

SEQ ID NO: 868 - protein, 312 aa, Corynebacterium glutamicum
MVGSSGLRVSRLGLGTSTWGSGTELAEAGDIFKAFINSGGTLIDVSPNYTTGVAEEMLGTMLDAEVSRSAVVISSSAGVNPALPLGRRVDCSRRNLIAQLDVTLRALNTDYLDLWSVGYWDEGTPPHEVADTLDYAVRTGRVRYAGVRGYSGWQLAVTHAASNHAAASARPVVVAQNEYSLLERRAEQELLPATQHLGVGFFAGAPLGQGVLTAKYRSEIPHDSRAASTGRDAEVQSYLDNRGRIIVDALDTAAKGLGISPAVTATTWVRDRPGVTAVIVGARTHEQLSHLLKAESVTLPTPITQALDDVSL

SEQ ID NO: 869 - DNA, 621 bp, Corynebacterium glutamicum; identical to SEQ ID NO: 215
  CDS (101)..(598): RXS03074

SEQ ID NO: 870 - protein, 166 aa, Corynebacterium glutamicum; identical to SEQ ID NO: 216

SEQ ID NO: 871 - DNA, 621 bp, Corynebacterium glutamicum; identical to SEQ ID NO: 215
  CDS (101)..(598): FRXA02906

SEQ ID NO: 872 - protein, 166 aa, Corynebacterium glutamicum; identical to SEQ ID NO: 216

SEQ ID NO: 873 - DNA, 1752 bp, Corynebacterium glutamicum; identical to SEQ ID NO: 493
  CDS (101)..(1729): RXA02315

SEQ ID NO: 874 - protein, 543 aa, Corynebacterium glutamicum; identical to SEQ ID NO: 494

SEQ ID NO: 875 - DNA, 1080 bp, Corynebacterium glutamicum; identical to SEQ ID NO: 497
  CDS (101)..(1057): RXA02319

SEQ ID NO: 876 - protein, 319 aa, Corynebacterium glutamicum; identical to SEQ ID NO: 498

SEQ ID NO: 877 - DNA, 1017 bp, Corynebacterium glutamicum; identical to SEQ ID NO: 477
  CDS (101)..(994): RXS00393

SEQ ID NO: 878 - protein, 298 aa, Corynebacterium glutamicum; identical to SEQ ID NO: 478

SEQ ID NO: 879 - DNA, 1005 bp, Corynebacterium glutamicum; identical to SEQ ID NO: 479
  CDS (101)..(982): FRXA00393

SEQ ID NO: 880 - protein, 294 aa, Corynebacterium glutamicum; identical to SEQ ID NO: 480

SEQ ID NO: 881 - DNA, 843 bp, Corynebacterium glutamicum; identical to SEQ ID NO: 475
  CDS (101)..(820): RXA00391

SEQ ID NO: 882 - protein, 240 aa, Corynebacterium glutamicum; identical to SEQ ID NO: 476

SEQ ID NO: 883 - DNA, 384 bp, Corynebacterium glutamicum; identical to SEQ ID NO: 499
  CDS (101)..(361): RXS02908

SEQ ID NO: 884 - protein, 87 aa, Corynebacterium glutamicum; identical to SEQ ID NO: 500

SEQ ID NO: 885 - DNA, 705 bp, Corynebacterium glutamicum
  CDS (101)..(682): RXA00997
cccatctgtggcagatcgaatgcacccaccgcggagaagtcgtcgcacgaaccacactgcgcaccatggtgctgaacaagtagccctatactcgggcaccatgactacatggaaagagctcacagataacaacccagcgcactcagaaaactacgcgcagcgctggcgaaacctcgccgcagcaggcaatgatatttacggcgaagcccgcctcattgatgccatggcacccaggggagcgaaaatcttggatgctggctgcggccagggacgcatcggtggctacctgtccaagcaaggccacgatgttctaggcacagaccttgatcccatcctgattgattacgccaagcaggactttccagaagctcgctgggtggtgggagatctctctgttgatcagatctcagagactgattttgatctcattgtctccgccggcaacgtcatgggctttctcgctgaggatggtcgcgaacctgcactagccaacattcaccgcgcactgggcgccgatggccgcgctgtcatcggtttcggcgcaggacgtggatgggtctttggagacttcctcgaagtcgcagaacgcgtgggcctcgagttggaaaatgcttttgagtcttgggatcttaagccttttgtccaaggctctgagttcttagtggcggtatttaccaagaagtaacacctctatcttgcacctga

SEQ ID NO: 886 - protein, 194 aa, Corynebacterium glutamicum
MTTWKELTDNNPAHSENYAQRWRNLAAAGNDIYGEARLIDAMAPRGAKILDAGCGQGRIGGYLSKQGHDVLGTDLDPILIDYAKQDFPEARWVVGDLSVDQISETDFDLIVSAGNVMGFLAEDGREPALANIHRALGADGRAVIGFGAGRGWVFGDFLEVAERVGLELENAFESWDLKPFVQGSEFLVAVFTKK

SEQ ID NO: 887 - DNA, 861 bp, Corynebacterium glutamicum
  CDS (101)..(838): RXA02189
aatggcaaaaatgggcacatacgatactgatgggaccaatgggaaaacctcaagccaccaattgagccagttctctcaagcaaaccgatactggtgggatgtggacgcggccgactatcacgaacgccacccttcttatttaggcacggattccgctcacggcgagttctactggtgccccgagatgctgcatgaaaaagatgtacgtcttcttggcactcccgcagcactctccggcaagaaaattttagagatcggttgcggctcggcaccgtgtgctcggtggctggccaatgatgttccgaatgcctttgtcaccgctttcgacatttcttcacaaatgctcaaatacgcaggtcacgaccataacgtacacctcgtacaggccgatgcaatgtcactcccctacgccgacagttcctttgacgtggtcttttccgttttcggcgccatcccctttgtggaggattccgccgcactcatgaaggaaatcgcgcgcgtcctcaaacccggcggacgcctcattttctccatcacccacccgatgcgctggattttcctcgacgatcccggccccgcaggcctcaccgcgatcaccagctacttcgaccagcgcggctacgtcgaagaagacgaggaaaccggtgctttaagctatgcggaacagcaccgcaccatgggcgcgcggatcaatgagcttatcgacgcctccctccacttagatcacctcatcgaaccagaatggccagatgagttggaagaaaactggggccaatggtcaccacttcgaggaaagctcttccccgggacagcaatcttcctcgccacgtaccgcccctaaaaaaccaacggcgctcattt

SEQ ID NO: 888 - protein, 246 aa, Corynebacterium glutamicum
VDAADYHERHPSYLGTDSAHGEFYWCPEMLHEKDVRLLGTPAALSGKKILEIGCGSAPCARWLANDVPNAFVTAFDISSQMLKYAGHDHNVHLVQADAMSLPYADSSFDVVFSVFGAIPFVEDSAALMKEIARVLKPGGRLIFSITHPMRWIFLDDPGPAGLTAITSYFDQRGYVEEDEETGALSYAEQHRTMGARINELIDASLHLDHLIEPEWPDELEENWGQWSPLRGKLFPGTAIFLATYRP

SEQ ID NO: 889 - DNA, 813 bp, Corynebacterium glutamicum
  CDS (101)..(790): RXA02311
cattttgggtatcggttggttgtccatcggtggagctaagggcgctaagcatcgcagccaaataacctcccactaaagctcctgggttagactcgaacgcgtggctaaagcagatttagacaaggaccccttcgacgtagcgtcaatgttcgatgacgtcggaaagaactacgatctcaccaataccgtgctttcttttggtcaggaccgtgtgtggcgaaagcgcactaggcagcgcctggacctcaagccaggggagaaggtgcttgatctagctgcaggaacagccgtttccaccgtggagttggcaaaatccggcgcgttttgtgtggcgtgtgatttctcccagggcatgctcgccgcaggtaaagaccgcgatgtgtccaaggttgtgggcgatggcatgcagttgccgtttgcagacaacagctttgatgctgtgaccatttcttatggtctgcgcaatattcacgatttccgcgctggcctgaaagaaatggcccgcgtgactaaacctggtggacgcctcaccgtggcggagttctccacccccgtgatccctgtgttcggcaccgtgtacaaggagtacctcatgcgcctgctgccccaggcggcgcgcgcagtatcgtccaacccggaggcctacatttacctggctgattccatccgcgcatggcctagccaggcggaactagcacgggagatcaaccagaatggttggtcagattgcggttggcagaacctgaccttcggcatcgtcgcgctgcactcggcgattaaaccagagaactagtcgagtcccacagaggggag

SEQ ID NO: 890 - protein, 230 aa, Corynebacterium glutamicum
VAKADLDKDPFDVASMFDDVGKNYDLTNTVLSFGQDRVWRKRTRQRLDLKPGEKVLDLAAGTAVSTVELAKSGAFCVACDFSQGMLAAGKDRDVSKVVGDGMQLPFADNSFDAVTISYGLRNIHDFRAGLKEMARVTKPGGRLTVAEFSTPVIPVFGTVYKEYLMRLLPQAARAVSSNPEAYIYLADSIRAWPSQAELAREINQNGWSDCGWQNLTFGIVALHSAIKPEN

SEQ ID NO: 891 - DNA, 876 bp, Corynebacterium glutamicum
  CDS (101)..(853): RXN02912
catcggtgtcggttcactgatggtggccaagaaggttggataacagggttaatcttgggtgatattgaaatgacgtattcctgattgggctgaaaaatctgtgacatcacctgaattacaaaacatccttaacaattattggagcggcagggcagaggcttaccacctcaaccaaacccaaagcgagcgtgcacaatttgaacgccccatctgggaaaaggtgtggtcgaaggctttgcctatcgtgtcggaagaagcggtaaaggttctcgatcttggctgtggcgctggttatgtcacccaccttctaagcgattgcggatacgaaacaatcggcgttgatggttctgaggaaatgatcaatcaagctacgcaggagaatggtcttcgcaggtcgacgggtcgggcgactgccatttttcaggtcggggatgcgcatgatcccgagttccgggaaggctcttttgatgcgataaccagccggtatgtgttgtggactctgctggatccccaggcagcgattaatcgttgggtgtctttgctaaaacctggtggggttattgcgtgcgtagatgcggcttggtatccgaagggcattgatgctggcacggaagtagattcagtggatggtccgagtgctttcgtagagacctataccccggaacttttgaggaatcttcccatgtcaacgacctccactggccacaatttcgcagagcttttccacaacgctggcctcaaagaagtcacattgacacccattgaggggctggctgaacttgaccagcgatttggcctctcaccagggcatgagtcgactccgcagttcctattcaggggaattaaatccagttagtgctgttttaagcggtcgag

SEQ ID NO: 892 - protein, 251 aa, Corynebacterium glutamicum
VTSPELQNILNNYWSGRAEAYHLNQTQSERAQFERPIWEKVWSKALPIVSEEAVKVLDLGCGAGYVTHLLSDCGYETIGVDGSEEMINQATQENGLRRSTGRATAIFQVGDAHDPEFREGSFDAITSRYVLWTLLDPQAAINRWVSLLKPGGVIACVDAAWYPKGIDAGTEVDSVDGPSAFVETYTPELLRNLPMSTTSTGHNFAELFHNAGLKEVTLTPIEGLAELDQRFGLSPGHESTPQFLFRGIKSS

SEQ ID NO: 893 - DNA, 585 bp, Corynebacterium glutamicum
  CDS (101)..(562): RXS00998
aatcggcctaaaaggtgtgaccatttgggggtagtggcgattttaccaggtcacaggaggtgaaaatccaaccattttaggccgactagagtaattaattatgacttcccgcgatgatcaaccccaagatctgctttcgcttgcagaacttgccgccaccagagctttaaccacagacgaacttgaagcactcaacaacgccaattatggcctcgaccgcaatctggggctgcgctacaccaccatcgagcccggccgggtggtcagcgaacttcacgtggcatccaagcacctgcaagtggtgggcttggtcaacggtggtgtctacgccgccatcgccgaatccactggatcagtcgccagcatgatttccgcccctggaaaaatggtcgtcggcatcaacaacaacaccgacttcatttctgctgtgagctccggtgtcatcgtggccgaagcaacgccgattcagctaggtggccgcacccatctgtggcagatcgaatgcacccaccgcggagaagtcgtcgcacgaaccacactgcgcaccatggtgctgaacaagtagccctatactcgggcaccatg

SEQ ID NO: 894 - protein, 154 aa, Corynebacterium glutamicum
MTSRDDQPQDLLSLAELAATRALTTDELEALNNANYGLDRNLGLRYTTIEPGRVVSELHVASKHLQVVGLVNGGVYAAIAESTGSVASMISAPGKMVVGINNNTDFISAVSSGVIVAEATPIQLGGRTHLWQIECTHRGEVVARTTLRTMVLNK

SEQ ID NO: 895 - DNA, 1098 bp, Corynebacterium glutamicum
  CDS (101)..(1075): RXA01215
tcgaaggctgggtgcaaaagaagcgccctggaaccgctgcagcacaagccgcagaagccgcccaaaacgtccacaaccaggaaggctaagcaggatcctcatgactgctcactggaaacaaaaccaaaagaacctcatgctgttttcgggtcgtgcgcacccagaactggcagaagctgtagctaaagagctcgacgtcaacgtcaccccaatgacggcacgcgatttcgccaacggtgaaatctacgtccgcttcgaggaatcagttcgtggctccgactgcttcgtcctgcagtcccacacccagcctctcaacaagtggctcatggaacagctgctgatgatcgacgctttgaagcgtggttccgcaaagcgcatcaccgcgatcctgccgttctacccatatgcccgccaggacaagaagcaccgcggccgcgagccaatttctgctcgcctcatcgccgacctcatgctcaccgctggcgcggaccgtatcgtgtccgtggacttgcacaccgatcagatccagggcttcttcgacggcccagtcgatcacatgcacgccatgccgatcctcaccgatcacatcaaggaaaactacaacctggacaacatctgcgtggtctcccctgacgcaggtcgcgtgaaggttgcagagaagtgggctaacaccttgggcgatgccccaatggcgttcgtgcacaagacccgctccaccgaggtagcaaaccaggttgtcgccaaccgcgtcgtcggtgacgtcgacggcaaggactgcgtgcttctcgacgacatgatcgacactggcggcaccatcgccggcgctgtgggcgtcctgaagaaggctggcgcaaagtcagtcgtcatcgcctgcacccacggtgtgttctctgacccagcccgcgagcgcctgtctgcatgcggtgctgaagaagtcatcaccaccgacaccctgccacagtccaccgagggctggagcaacctgaccgttttgtcgatcgcaccgctgctggctcgcaccatcaacgagatcttcgaaaacggttccgtcaccaccctcttcgagggcgaggcctaaacacccatgcccaccacgga

SEQ ID NO: 896 - protein, 325 aa, Corynebacterium glutamicum
MTAHWKQNQKNLMLFSGRAHPELAEAVAKELDVNVTPMTARDFANGEIYVRFEESVRGSDCFVLQSHTQPLNKWLMEQLLMIDALKRGSAKRITAILPFYPYARQDKKHRGREPISARLIADLMLTAGADRIVSVDLHTDQIQGFFDGPVDHMHAMPILTDHIKENYNLDNICVVSPDAGRVKVAEKWANTLGDAPMAFVHKTRSTEVANQVVANRVVGDVDGKDCVLLDDMIDTGGTIAGAVGVLKKAGAKSVVIACTHGVFSDPARERLSACGAEEVITTDTLPQSTEGWSNLTVLSIAPLLARTINEIFENGSVTTLFEGEA

SEQ ID NO: 897 - DNA, 1470 bp, Corynebacterium glutamicum
  CDS (101)..(1447): RXN00558
gaacaggcaccgcaggaagaatgcggcgttttcggcgtttgggcgccaggtgaggaagtctcgaaacttacctactttggcctcttcgcacttcagcaccgtggtcaagaagcccgcgggcatcgcagtaggcgatggcgaacagatcctggttttcaaagatttgggcctagtctcccaagttttcgaccaaccaattctggaatccctccgcggaaacatcgccatcggacacacccgatacaccaccgccggcggaaacacctgggaaaatgcccagcctatgttccgcatggcaccagatggcaccgatatcgcccttggacacaacggcaacctgattaattacatcgagttgttggacaaagccaccgaacttggcctcgtcgatcccgccaagaagccatcagataccgatgtgctcactggactgctcgcaagcggcgtccatgacggaaataatctctttgattccgccaaggaactcctccccagcgtcaagggagcctactgcctcaccttcaccgacggacacaccctgtacgcagcgcgtgatccattcggcatccgcccactgtccatcggccgcctcgagcgcggctgggtagtcgcatctgaaaccgcagcgctcgacatcgtaggtgcctcgcatgtgcgcgaggtcgaaccaggcgaactgattgctatcgacgaatccggcctcaagtccgcacgattcgccgagacaacccgcaaaggttgcgtcttcgaatacgtttacctggctcgtccagactccgtgatcaagggaagaaacgtcaacgaagcccgacttgaaatcggccgcaagctcgctgcagaagcaccagcagtcggcgatctagtcatcccaaccccagaatcaggcaccccagcagcagttggattcgcccaagcatctggcatcccattcggccaaggcatggtcaaaaacgcctacgttggccgaaccttcatccagccttccgacactctccgccaactgggaatccgcctcaagctgaacccattgcgcgaggttatcgccggaaagcgccttgtggttgtggatgattccatcgtccgcggtaacacccaacgcgccgtgatccgcatgttgcgcgaagccggtgcagctgaggttcacgtacgcatcgcctcaccacccgtgaaatggccatgcttctacggcatcgattttgccaccccaggcgaactcattgccaacgctgtcaccagtgacaacgaagcagaaatggtagaagcagtccgctccgcaatcggcgcagacaccctcggctacgtctccatcgactccatggttgcagcaaccgagcaaccagccaacgaactctgcatcgcctgcttcgacggcaaataccccatgggtctgccacagggaaacagcaacgcagacctagtccgcaagatgcaagcaaccgcctcaagttaagatcggtaggcgataggggt

SEQ ID NO: 898 - protein, 449 aa, Corynebacterium glutamicum
VVKKPAGIAVGDGEQILVFKDLGLVSQVFDQPILESLRGNIAIGHTRYTTAGGNTWENAQPMFRMAPDGTDIALGHNGNLINYIELLDKATELGLVDPAKKPSDTDVLTGLLASGVHDGNNLFDSAKELLPSVKGAYCLTFTDGHTLYAARDPFGIRPLSIGRLERGWVVASETAALDIVGASHVREVEPGELIAIDESGLKSARFAETTRKGCVFEYVYLARPDSVIKGRNVNEARLEIGRKLAAEAPAVGDLVIPTPESGTPAAVGFAQASGIPFGQGMVKNAYVGRTFIQPSDTLRQLGIRLKLNPLREVIAGKRLVVVDDSIVRGNTQRAVIRMLREAGAAEVHVRIASPPVKWPCFYGIDFATPGELIANAVTSDNEAEMVEAVRSAIGADTLGYVSIDSMVAATEQPANELCIACFDGKYPMGLPQGNSNADLVRKMQATASS

SEQ ID NO: 899 - DNA, 524 bp, Corynebacterium glutamicum
  CDS (61)..(501): FRXA00558
gggcgccaggtgaggaagtatcgcagctcacctactttggcctcttcgcagttcagcaccgtggtcaagaagcccgcgggcatcgcagtaggcgatggcgaacagatcctggttttcaaagatttgggcctagtctcccaagttttcgaccaaccaattctggaatccctccgcggaaacatcgccatcggacacacccgatacaccaccgccggcggaaacacctgggaaaatgcccagcctatgttccgcatggcaccagatggcaccgatatcgcccttggacacaacggcaacctgattaattacatcgagttgttggacaaagccaccgaacttggcctcgtcgatcccgccaagaagccatcagataccgatgtgctcactggactgctcgcaagcggcgtccatgacggaaataatctctttgattccgccaaggaactcctccccagcgtcaagggagcctactgcctcaccttcaccgacggacacaccctgtaagcagcgcgtgatccattcgg

SEQ ID NO: 900 - protein, 147 aa, Corynebacterium glutamicum
VVKKPAGIAVGDGEQILVFKDLGLVSQVFDQPILESLRGNIAIGHTRYTTAGGNTWENAQPMFRMAPDGTDIALGHNGNLINYIELLDKATELGLVDPAKKPSDTDVLTGLLASGVHDGNNLFDSAKELLPSVKGAYCLTFTDGHTL

SEQ ID NO: 901 - DNA, 1386 bp, Corynebacterium glutamicum
  CDS (101)..(1363): RXN00626
tcattttaaggcgcttttcgacgccactttcaaccatttccgaaccgccaagaatactggaatagcttggatcaagttttgcaggataaactgtgcaaccatgcgcattctggtaatcggctcgggcgcccgtgagcacgccctcctccgtggactgtcaactgaccctgcaaccactgaactccacgttgccccaggtaacgctggtcttggatcgatcgcaactgtccaccctggcatcaaggctgatgatccagaggctgtcactgcgttggctaaagaactgaactctgatctggttgttatcggcccagagatccctttggttgcgggtgttgctgatgcacttcgcgcggcgggtatcgctgtgtttggtcctaacaaggacgctgctcgtatcgagggctccaaggctttcgctaaggatgtcatggctgcgcagggtgttcgtactgctcatgctgagactattactcctggtgcgtcttctgaagatattgatgctgccatagatcgtttcggcccaacgtgggttgtcaaggatgatggtttgtctgcgggcaagggtgttgtggttacccccgatcgtgcagcagcacgtgctcacgtagatgcagtgcttgagggcggaaatccagttttgctggagtccttccttgatggccctgaggtttccctgttctgcctggttgatggcgagacggtagttcctctgctgccagcgcaggatcacaagcgtgcgtacgacaacgatgagggcccaaacactggtggcatgggtgcttatgcgccgcttccttggctgcctgaagatggcgtccagcgcattgtcgatgaggtctgcgttcctgttgctcgtgagatggtggcacgtggttgcgcgtactccggtctgctttacgcaggtatcgcatggggtgcagaaggccctgcagtagtggagttcaactgccgcttcggcgatccagaaacccaggctgtactggcactactgaagactcctctagcagtactgctcaacgcagttgctactggaaccttggcagagcagccagcactggagtgggaggatgcttacgccctgactgtggtgttggcttcttacaactacccagaggcacctcgtactggtgatgtcatccgcaacgctgatgcagataacgttcttcacgctggtaccgcactcaatgctgaaggcgagctggtctctgcgggcggtcgtgttcttaacgtgatcggtgtgggtgagaccctggaggctgcacgcgataacgcgtacaccaccatcaaggacattgaacttgagggaagccactaccgcagcgatatcgcattggctgcattagagggtcgtatctcgatctaaaagcagtacgcagataggct

SEQ ID NO: 902 - protein, 421 aa, Corynebacterium glutamicum
MRILVIGSGAREHALLRGLSTDPATTELHVAPGNAGLGSIATVHPGIKADDPEAVTALAKELNSDLVVIGPEIPLVAGVADALRAAGIAVFGPNKDAARIEGSKAFAKDVMAAQGVRTAHAETITPGASSEDIDAAIDRFGPTWVVKDDGLSAGKGVVVTPDRAAARAHVDAVLEGGNPVLLESFLDGPEVSLFCLVDGETVVPLLPAQDHKRAYDNDEGPNTGGMGAYAPLPWLPEDGVQRIVDEVCVPVAREMVARGCAYSGLLYAGIAWGAEGPAVVEFNCRFGDPETQAVLALLKTPLAVLLNAVATGTLAEQPALEWEDAYALTVVLASYNYPEAPRTGDVIRNADADNVLHAGTALNAEGELVSAGGRVLNVIGVGETLEAARDNAYTTIKDIELEGSHYRSDIALAALEGRISI

SEQ ID NO: 903 - DNA, 364 bp, Corynebacterium glutamicum
  CDS (101)..(364): FRXA00629
tcattttaaggcgcttttcgacgccactttcaaccatttccgaaccgccaagaatactggaatagcttggatcaagttttgcaggataaactgtgcaaccatgcgcattctggtaatcggctcgggcgcccgtgagcacgccctcctccgtggactgtcaactgaccctgcaaccactgaactccacgttgccccaggtaacgctggtcttggatcgatcgcaactgtccaccctggcatcaaggctgatgatccagaggctgtcactgcgttggctaaagaactgaactctgatctggttgttatcggcccagagatccctttggttgcgggtgttgctgatgcacttcgcgcggcgggtatc

SEQ ID NO: 904 - protein, 88 aa, Corynebacterium glutamicum
MRILVIGSGAREHALLRGLSTDPATTELHVAPGNAGLGSIATVHPGIKADDPEAVTALAKELNSDLVVIGPEIPLVAGVADALRAAGI

SEQ ID NO: 905 - DNA, 803 bp, Corynebacterium glutamicum
  CDS (1)..(780): FRXA00626
gatcgtgcagcagcacgtgctcacgtagatgcagtgcttgagggcggaaatccagttttgctggagtccttccttgatggccctgaggtttccctgttcttcctggttgatggcgagacggtagttcctctgctgccagcgcaggatcacaagcgtgcgtacgacaacgatgagggcccaaacactggtggcatgggtgcttatgcgccgcttccttggctgcctgaagatggcgtccagcgcattgtcgatgaggtctgcgttcctgttgctcgtgagatggtggcacgtggttgcgcgtactccggtctgctttacgcaggtatcgcatggggtgcagaaggccctgcagtagtggagttcaactgccgcttcggcgatccagaaacccaggctgtactggcactactgaagactcctctagcagtactgctcaacgcagttgctactggaaccttggcagagcagccagcactggagtgggaggatgcttacgccctgactgtggtgttggcttcttacaactacccagaggcacctcgtactggtgatgtcatccgcaacgctgatgcagataacgttcttcacgctggtaccgcactcaatgctgaaggcgagctggtctctgcgggcggtcgtgttcttaacgtgatcggtgtgggtgagaccctggaggctgcacgcgataacgcgtacaccaccatcaaggacattgaacttgagggaagccactaccgcagcgatatcgcattggctgcattagagggtcgtatctcgatctaaaagcagtacgcagataggct

SEQ ID NO: 906 - protein, 260 aa, Corynebacterium glutamicum
DRAAARAHVDAVLEGGNPVLLESFLDGPEVSLFFLVDGETVVPLLPAQDHKRAYDNDEGPNTGGMGAYAPLPWLPEDGVQRIVDEVCVPVAREMVARGCAYSGLLYAGIAWGAEGPAVVEFNCRFGDPETQAVLALLKTPLAVLLNAVATGTLAEQPALEWEDAYALTVVLASYNYPEAPRTGDVIRNADADNVLHAGTALNAEGELVSAGGRVLNVIGVGETLEAARDNAYTTIKDIELEGSHYRSDIALAALEGRISI

SEQ ID NO: 907 - DNA, 714 bp, Corynebacterium glutamicum
  CDS (101)..(691): RXA02623
aatcctgaagaggaagaatccgacgaagaaattgagacagaaactgaggctgaagaaaccaatgatggttccgaggccgaagaccgttaacatatctgttgtgaattctgactctacgaccaccattgtcgtgctagcttccggaacaggcaccctccttcagtcactcattgaagcgcaaggtacctattcgatcgtgggcgttgtctctgacgtcgaatgccctgcactttccagagccgcagatgcaggtattgatactgcagttgttccgcttggaaaagatcgtgcacagtggaaccacgagcttgcagacgcagttgcagtaagcgacccagatttggtggtctctgcgggattcatgaaaattttgggcgaaggtttcctctcaaggttcccgtcccgcatcatcaacacccacccagctttattgccttctttccctggtgcccacgcggttcgcgatgctttggcatacggtgtgaaagtgtcaggttcgacagttcaccttgtcgatgctggtgtggataccggcccaattattgctcaacgagcagtgccggtagaagtgaatgatgatgaatccagcctgcatgaaagaatcaagcaggttgagcgtaaactcattgtagaagtcctgaacagcgtggaattttcgcgtcagggtggcgtacaactcaactggagaggctaaatccttcatgagcgatgatc

SEQ ID NO: 908 - protein, 197 aa, Corynebacterium glutamicum
VNSDSTTTIVVLASGTGTLLQSLIEAQGTYSIVGVVSDVECPALSRAADAGIDTAVVPLGKDRAQWNHELADAVAVSDPDLVVSAGFMKILGEGFLSRFPSRIINTHPALLPSFPGAHAVRDALAYGVKVSGSTVHLVDAGVDTGPIIAQRAVPVEVNDDESSLHERIKQVERKLIVEVLNSVEFSRQGGVQLNWRG

SEQ ID NO: 909 - DNA, 1347 bp, Corynebacterium glutamicum
  CDS (101)..(1324): RXA01442
aattaagcaacctttttaacaggtttagagctttcacgaggtggcgtcagataaagtgaacaccaatatttctgacatcttccaacggaggctaaaaggcatgtacatcccagagtcgatcggcacccctttgacccccaatgccacgaaagtgatgctgctgggatcaggagaattaggcaaagaagtagccatcgctttccagcgtctcggcctggaagtccatgcagttgatcgctacgaacatgccccagcccaccaggtcgctcacttctcctatgtcatcgacatgacagatgcagcccaggtgcgggaattggtggagcgtgtgcgcccagattttgtcattcctgaaatcgaagcactggcaaccgatgaactggtgaagatcgaagaagaggggctagctaccatcgtgcccactgcacgtgcagccaagctgaccatgaaccgcgaaggcatccgcaagctggcggcagaggaactgggtcttccaacctccaactatgagttctgctccactttcgaggaattctccgcagctgctgaaaagcttggttaccccaacgtggtgaaaccagtgatgagttcttccggcaagggccaatctgttttgcgtagttcagacgatctgcaggcagcatgggattatgcgatgagcggtgcacgcgtggccaactcccgcgtcatcgtggaagctttcgtggaattcgattacgagatcaccctgttgacagtaaggtccatcgatcccaccacctctaagcctgcgacctggttctgtgagcccattgggcaccgccaagaagacggcgactacgtggaatcctggcagccaatggagatgactcctcgcgcgctggaaaacgcacgctcagtagccgcacgcatcaccaacgcattgggcggacgcggcgtatttggtgtggagctctttgtctccggcgatgacgtgtacttctctgaagtctccccacgcccacacgacaccggccttgtcacccttgccacccagcgtttctctgaatttgaactccacgccaaggcaattctgggattgcctgttgatgtcaccctgatttctccaggtgcctccgctgtcatctacggtggcatcgaatctgaaggcgtgagctacaccgggttggctgaagcgctggcagtggctgaaactgatcttcgtatctttgccaagccagaggccttcaccaagcgtcgcatgggtgttgcagtgtccaccgctgaggatgtggctgcagccagggaccgcgccactttggctgccgcggcgatcaaggttcatccaggaaattccgcagaggcttaacatgctgggaaagcatcggg

SEQ ID NO: 910 - protein, 408 aa, Corynebacterium glutamicum
MYIPESIGTPLTPNATKVMLLGSGELGKEVAIAFQRLGLEVHAVDRYEHAPAHQVAHFSYVIDMTDAAQVRELVERVRPDFVIPEIEALATDELVKIEEEGLATIVPTARAAKLTMNREGIRKLAAEELGLPTSNYEFCSTFEEFSAAAEKLGYPNVVKPVMSSSGKGQSVLRSSDDLQAAWDYAMSGARVANSRVIVEAFVEFDYEITLLTVRSIDPTTSKPATWFCEPIGHRQEDGDYVESWQPMEMTPRALENARSVAARITNALGGRGVFGVELFVSGDDVYFSEVSPRPHDTGLVTLATQRFSEFELHAKAILGLPVDVTLISPGASAVIYGGIESEGVSYTGLAEALAVAETDLRIFAKPEAFTKRRMGVAVSTAEDVAAARDRATLAAAAIKVHPGNSAEA

SEQ ID NO: 911 - DNA, 2409 bp, Corynebacterium glutamicum
  CDS (101)..(2386): RXN00537
acccggaacatgccgtcgaaaagctaaccggcccatctattgatggcctggagctgttcctgtccgccgttggcaccatcgcggcttaagaggagtaaatatgagcacttttgtcaatgacaccgtcgaagacgcaatcaagacccctgagctggatcagccatttgaggctcttggtctgaaagacgacgagtacgcgcgcatcaaggaaatccttggccgccgcccaaccgacgccgagctgaccgtttactccgtcatgtggtcggagcactgctcctacaagtcctccaaggttcacctgcgttacttcggtgaaaccaccactgaggaaatggcttccaagattcttgccggcatcggcgagaacgctggtgtggtcgacatcggagacggcaacgccgtgaccttccgcgtggagtcccacaaccacccatccttcgtagagccacaccagggcgctgcgaccggcgtcggcggcatcgtccgcgacattatggctatgggcgcacgcccaatcgctgtgatggatcagctgcgtttcggtgcactggacaacccagacacccagcgtgtgtttcctggcgttgttgacggcatttcccattacggcaactgcctcggcctgccaaacatcggtggcgaaaccgtcttcgacgattcctacgcaggtaacccactggtcaacgcactgtgcgtgggtaccctcaaggtggaagacctcaagcttgcattcgcatccggcaccggcaacaaggtgatcctgttcggttcccgcaccggccttgatggcatcggtggcgtgtccgtcctgggttccgcatccttcgaagaaggcgaagagcgcaagctcccagctgttcaggttggcgatcctttcgcagagaaggtactcatcgagtgctgcctcgagctgtacaaggctggcgtcgtggtcggtattcaggacctcggtggcggcggacttgcgtgtgcaacctctgagctggcagccgcaggcgacggcggcatgcgcgtcaacctagacaacgtcccactgcgcgcagagaacatgtctgcagctgaaatcctggcttccgagtcccaggagcgcatgtgtgctgttgtcacccctgaaaacgttgagcgtttcctcgagatctgtgcaaagtgggatgtcacctgcgcagaaatcggcgaagttaccgacgagaaggaccgctacgttgtggtccacaacggtgaagttgttatcgacgcacctccatcaaccatcgatgaaggccctgtctacaaccgcccagttgctcgccctgagaaccaggacgaactgcagctcgaaggcgagatcgctcgcccagtcgacgttgaagagatcaaggctgcttggctgaagcttgtcgcttcaccagcacttgcatcccgcgcgtttatcaccgagcagtacgaccgctacgtccgcggcaacaccgttcaggcaaagaacgccaatgctggcgtcttgcgtatcgacgaagagaccaaccgtggcgttgcgatctccgccgacgcatccggccgttacaccaagctcgagccaaacactggcgcgcagcttgcactggctgaggcttaccgcaacgtggtctccaccggtgcacgcccagtggctgtcaccaactgcctgaacttcggttccccagaaaacgctggtgttatgtggcagttcaaggaagcagtccacggtctggcagacggatccaagcttttgggcattccagtgtccggcggtaacgtctccttctacaaccagactggtgacgagcccatcctgccaaccccagtcgtgggtgttttgggagtcttggacaacgtcgagcagagcatcggcaacgtcctcccatccgaggacaacgatctctacctcctgggtgagaccttcgatgagttcggtggctccatctggcagcaggtttctggcgctggcctcaacggtctgccaccagtagttgacctgctcaacgagcagcgtcttgcagacctgttcgtcggttctgatctgtttgctgcatcccacgatctgtctgagggcggccttggccagaccctcgcagagcttgcgatccaccagaaaaagggaatggatgttgatctctcccagatccacccatccctgttcacctcactgtttgctgagtccgcttcccgcatcgtggttgcaaccaaccgcggcgaagagttggaaaagcgcgcagcagagctgggtgttccagtgttcaagctgggctgcaccaacgattcagccgtcatcgctgtcaagggcgcagacgttgagttcactgtttccgtggaggaactccgcgaagcatggaccaacactttgcctgaggccttcggtcacgcagttggagctaacgcagtagttgcataattttctgctgtgaagccggg

SEQ ID NO: 912 - protein, 762 aa, Corynebacterium glutamicum
MSTFVNDTVEDAIKTPELDQPFEALGLKDDEYARIKEILGRRPTDAELTVYSVMWSEHCSYKSSKVHLRYFGETTTEEMASKILAGIGENAGVVDIGDGNAVTFRVESHNHPSFVEPHQGAATGVGGIVRDIMAMGARPIAVMDQLRFGALDNPDTQRVFPGVVDGISHYGNCLGLPNIGGETVFDDSYAGNPLVNALCVGTLKVEDLKLAFASGTGNKVILFGSRTGLDGIGGVSVLGSASFEEGEERKLPAVQVGDPFAEKVLIECCLELYKAGVVVGIQDLGGGGLACATSELAAAGDGGMRVNLDNVPLRAENMSAAEILASESQERMCAVVTPENVERFLEICAKWDVTCAEIGEVTDEKDRYVVVHNGEVVIDAPPSTIDEGPVYNRPVARPENQDELQLEGEIARPVDVEEIKAAWLKLVASPALASRAFITEQYDRYVRGNTVQAKNANAGVLRIDEETNRGVAISADASGRYTKLEPNTGAQLALAEAYRNVVSTGARPVAVTNCLNFGSPENAGVMWQFKEAVHGLADGSKLLGIPVSGGNVSFYNQTGDEPILPTPVVGVLGVLDNVEQSIGNVLPSEDNDLYLLGETFDEFGGSIWQQVSGAGLNGLPPVVDLLNEQRLADLFVGSDLFAASHDLSEGGLGQTLAELAIHQKKGMDVDLSQIHPSLFTSLFAESASRIVVATNRGEELEKRAAELGVPVFKLGCTNDSAVIAVKGADVEFTVSVEELREAWTNTLPEAFGHAVGANAVVA

SEQ ID NO: 913 - DNA, 638 bp, Corynebacterium glutamicum
  CDS (54)..(638): FRXA02805
tgtgatggatcagctgcgtttcgggtgcactggacaacccagacacccagcgtgtgtttcctggcgttgttgacggcatttcccattacggcaactgcctcggcctgccaaacatcggtggcgaaaccgtcttcgacgattcctacgcaggtaacccactggtcaacgcactgtgcgtgggtaccctcaaggtggaagacctcaagcttgcattcgcatccggcaccggcaacaaggtgatcctgttcggttcccgcaccggccttgatggcatcggtggcgtgtccgtcctgggttccgcatccttcgaagaaggcgaagagcgcaagctcccagctgttcaggttggcgatcctttcgcagagaaggtactcatcgagtgctgcctcgagctgtacaaggctggcgtcgtggtcggtattcaggacctcggtggcggcggacttgcgtgtgcaacctctgagctggcagccgcaggcgacggcggcatgcgcgtcaacctagacaacgtcccactgcgcgcagagaacatgtctgcagctgaaatcctggcttccgagtcccaggagcgcatgtgtgctgttgtcacccctgaaaacgttgagcgtttcctcgagatctgtgcaaagtgggatgtc

SEQ ID NO: 914 - protein, 195 aa, Corynebacterium glutamicum
VFPGVVDGISHYGNCLGLPNIGGETVFDDSYAGNPLVNALCVGTLKVEDLKLAFASGTGNKVILFGSRTGLDGIGGVSVLGSASFEEGEERKLPAVQVGDPFAEKVLIECCLELYKAGVVVGIQDLGGGGLACATSELAAAGDGGMRVNLDNVPLRAENMSAAEILASESQERMCAVVTPENVERFLEICAKWDV

SEQ ID NO: 915 - DNA, 697 bp, Corynebacterium glutamicum
  CDS (23)..(697): FRXA00537
  misc_feature 120: n = a, g, c, or t
  VARIANT 33: Xaa = Ile, Thr, Asn, or Ser
caacagcacttgcatcccgcgcgtgtatcaccgagcagtactgaacgctacgtccgcggcaacaccgttcaagcaaaagaacgccaatgctggcgtcttgcgtatcgacgaagagaccanccgtggcgttgcgatctccgccgacgcatccggccgttacaccaagctcgagccaaacactggcgcgcagcttgcactggctgaggcttaccgcaacgtggtctccaccggtgcacgcccagtggctgtcaccaactgcctgaacttcggttccccagaaaacgctggtgttatgtggcagttcaaggaagcagtccacggtctggcagacggatccaagcttttgggcattccagtgtccggcggtaacgtctccttctacaaccagactggtgacgagcccatcctgccaaccccagtcgtgggtgttttgggagtcttggacaacgtcgagcagagcatcggcaacgtcctcccatccgaggacaacgatctctacctcctgggtgagaccttcgatgagttcggtggctccatctggcagcaggtttctggcgctggcctcaacggtctgccaccagtagttgacctgctcaacgagcagcgtcttgcagacctgttcgtcggttctgatctgtttgctgcatcccacgatctgtctgagggcggccttggccagaccctcgcagagcttgcg

SEQ ID NO: 916 - protein, 225 aa, Corynebacterium glutamicum
  VARIANT 33: Xaa = Ile, Thr, Asn, or Ser
VYHRAVLNATSAATPFKQKNANAGVLRIDEETXRGVAISADASGRYTKLEPNTGAQLALAEAYRNVVSTGARPVAVTNCLNFGSPENAGVMWQFKEAVHGLADGSKLLGIPVSGGNVSFYNQTGDEPILPTPVVGVLGVLDNVEQSIGNVLPSEDNDLYLLGETFDEFGGSIWQQVSGAGLNGLPPVVDLLNEQRLADLFVGSDLFAASHDLSEGGLGQTLAELA

SEQ ID NO: 917 - DNA, 302 bp, Corynebacterium glutamicum
  CDS (1)..(279): FRXA00561
ctcttcccagatccacccatccctgttcacctcacttgtttgctgagtcccgcttcccgcatcgtggttgcaaccaaccgcggcgaagagttggaaaagcgcgcagcagagctgggtgttccagtgttcaagctgggctgcaccaacgattcagccgtcatcgctgtcaagggcgcagacgttgagttcactgtttccgtggaggaactccgcgaagcatggaccaacactttgcctgaggccttcggtcacgcagttggagctaacgcagtagttgcataattttctgctgtgaagccggg

SEQ ID NO: 918 - protein, 93 aa, Corynebacterium glutamicum
LFPDPPIPVHLTCLLSPASRIVVATNRGEELEKRAAELGVPVFKLGCTNDSAVIAVKGADVEFTVSVEELREAWTNTLPEAFGHAVGANAVVA

SEQ ID NO: 919 - DNA, 792 bp, Corynebacterium glutamicum
  CDS (101)..(769): RXA00541
atgattccgtcaccgaagctgacctaaagaaaattgctgaaaccctcctcgcaaacaccgtcatcgaagacttcgatgtggtgggagttgaggtcgcgaagtgagcgccaaaatcggtgtcattaccttcccaggcacccttgacgatgtagatgcagcacgcgctgctcgcatcgcaggtgcagaagtaatcagcctgtggcacgctgacgaggatctcaagggcgtcgacgcagttgtcgttcccggtggattctcctacggcgattacctgcgcaccggtgcaatctctgcactggcgccagtaatgcagtccgtgattgagcaggccggtaagggtatgccagtcttgggcatttgcaacggcttccagatcctcaccgaagcacgcctgcttccaggcgcgctgacccgcaacaagggtctgcactttcactgtgtagacgcacacctcgttgtagagaacaacaccactgcatggaccaacactttggaaaagggtcagcagatccttattcctgcaaagcacggtgaaggtcgcttccaggcagacgcagagaccatcgcccagcttgagggtgaaggccgcgtggtgttccgttacaccgataacttcaacggttccgtcaacgatatcgccggtatcactaatgaaactggtcgcatcgtcggtctcatgccgcacccggaacatgccgtcgaaaagctaaccggcccatctattgatggcctggagctgttcctgtccgccgttggcaccatcgcggcttaagaggagtaaatatgagcact

SEQ ID NO: 920 - protein, 223 aa, Corynebacterium glutamicum
VSAKIGVITFPGTLDDVDAARAARIAGAEVISLWHADEDLKGVDAVVVPGGFSYGDYLRTGAISALAPVMQSVIEQAGKGMPVLGICNGFQILTEARLLPGALTRNKGLHFHCVDAHLVVENNTTAWTNTLEKGQQILIPAKHGEGRFQADAETIAQLEGEGRVVFRYTDNFNGSVNDIAGITNETGRIVGLMPHPEHAVEKLTGPSIDGLELFLSAVGTIAA

SEQ ID NO: 921 - DNA, 1014 bp, Corynebacterium glutamicum
  CDS (101)..(991): RXA00620
ggtgatccatgtcaggaagccagcggtgaaaccggcagtgaaaccagcggtgaatgctaaaattttccgaacacacccgaggggtctagacttgcctaacatgcgtcctgaactctcccagtacaagcacctgtcggcaggcaaggtccgtgagatctacgagatcgacgacaagcacatcctcatggtggcttccgatcgtatctctgcatacgatttcatcctcgataccgaaattccagacaagggtcgagtgctcactgcgatgagccagttcttcttcgacaccatcgattttcctaatcaccttgcaggtcccgctgatgatccacgtatcccagaagaagttttgggacgagcaatggtgtgcaagaagctcaacatgcttccttttgaatgcgtggttcgtggatacctcactggctctggacttgttgaatacaagcagaccagctccgtgtgtggagttgagctcccagaaggcctcgttgaatcttctcagctgcctgagccaatctttaccccagccaccaaggctgacatcggcgaccacgacatcaatgtctcctttgacgttgttgaagaacgtctcggcgaagctcgtgcgaaccagttgcgcgatgcctctattgctatttacaaggctgctgctgagatcgcccgtgaccgtggcgtcatccttgccgacaccaaatttgagttcggcatcgatgaagatggcaccctcgtgcttggtgatgaagtccttaccccagattcctcccgctactggcctttggaaggctatgaagcaggatctgtgcaaccaagctttgataagcaattcgtgcgcaactggctcaccggccctaaatctggctgggacaaggattccggcttggagccaccagctctgccaggttccgttgttgaggcaacccgcgagcgctacatcgaggcctacgagctgatttctggtcagaagttctgccagtggattggttcttgcgtctaagctgcttgattttccctaaa

SEQ ID NO: 922 - protein, 297 aa, Corynebacterium glutamicum
MRPELSQYKHLSAGKVREIYEIDDKHILMVASDRISAYDFILDTEIPDKGRVLTAMSQFFFDTIDFPNHLAGPADDPRIPEEVLGRAMVCKKLNMLPFECVVRGYLTGSGLVEYKQTSSVCGVELPEGLVESSQLPEPIFTPATKADIGDHDINVSFDVVEERLGEARANQLRDASIAIYKAAAEIARDRGVILADTKFEFGIDEDGTLVLGDEVLTPDSSRYWPLEGYEAGSVQPSFDKQFVRNWLTGPKSGWDKDSGLEPPALPGSVVEATRERYIEAYELISGQKFCQWIGSCV

SEQ ID NO: 923 - DNA, 1293 bp, Corynebacterium glutamicum
  CDS (101)..(1270): RXN00770
ccatgggtctgccacagggaaacagcaacgcagacctagtccgcaagatgcaagcaaccgcctcaagttaagatcggtaggcgataggggttgagcatttttgctctccccgtatgcgtgggggttgtcccgcgcacttttagacagttatgttcctaataagttccaaaccccagcaggagaagcgaagtacacgatgagtgatcaccaggacaccaccgccgaaggcgtttcatacgcagcagcaggagtcgacatcgaagccggcgatcgtgccgtcgaactctttgcaccaatggccaagcgcgccacccgcccagaggttcttggcaacctcggaggcttcgcaggactctttgagctcggaaaatacaagaagccaatcctcgcagcaggatctgacggagtcggcaccaagcttgtcatcgcccagatgatggacaagcacgacaccatcggcatcgaccttgttgcaatgtgtgtggatgacctcgttgtcaccggcgcagagccactgttcctccaggactacatcgccatcggcaaggttgtcccagagcacgttgctgagatcgtctccggtatcgcagaaggctgtgtccaggcaggctgtgctctgctcggtggcgaaaccgcagaacacccaggtgttatggaaccagaccactacgatgtctccgcaactgcagtcggcgttgtcgaagcagatgaactgctaggaccagaccgcgtccgcgcaggcgacgtcctcatcggcatggcttcctccggtctgcactccaacggttactccctggctcgccacgtcctcctggaaaaggcaggcctggcgcttgacggacacatcgaagaactcggacgcaccctcggtgaagaacttctcgagccaacccgcatctacgccaaggactgcctggcactgatcgcagagtgcgaagttcacaccttctgccacgtcaccggcggcggcctcgcaggcaacctcgagcgggttgtcccagaagggctcgtcgcagaaatgtcccgagcaacttggaccccaggccaaatcttccgcaccatctcctctgtgggcaaggtttcccgcgaagaaatggaaaagaccttcaacatgggtgtcggcatggttgcagtcgttgctgaaaaggaccgcgaccgcgccctggcaatgctcaccgcacgtcacattgactgctgggaaatcggaaccgtacgcaacggtgaagagggagagcctcgcgtgatcctcaacggcgagcaccctggctactaagcccaactgtctgctctaag

SEQ ID NO: 924 - protein, 390 aa, Corynebacterium glutamicum
LLSPYAWGLSRALLDSYVPNKFQTPAGEAKYTMSDHQDTTAEGVSYAAAGVDIEAGDRAVELFAPMAKRATRPEVLGNLGGFAGLFELGKYKKPILAAGSDGVGTKLVIAQMMDKHDTIGIDLVAMCVDDLVVTGAEPLFLQDYIAIGKVVPEHVAEIVSGIAEGCVQAGCALLGGETAEHPGVMEPDHYDVSATAVGVVEADELLGPDRVRAGDVLIGMASSGLHSNGYSLARHVLLEKAGLALDGHIEELGRTLGEELLEPTRIYAKDCLALIAECEVHTFCHVTGGGLAGNLERVVPEGLVAEMSRATWTPGQIFRTISSVGKVSREEMEKTFNMGVGMVAVVAEKDRDRALAMLTARHIDCWEIGTVRNGEEGEPRVILNGEHPGY

SEQ ID NO: 925 - DNA, 818 bp, Corynebacterium glutamicum
  CDS (15)..(818): FRXA00557
tgggttgagcatttttgctctccccgtatgcgtgggggttgtcccgcgcacttttagacagttatgttcctaataagttccaaaccccagcaggagaagcgaagtacacgatgagtgatcaccaggacaccaccgccgaaggcgtttcatacgcagcagcaggagtcgacatcgaagccggcgatcgtgccgtcgaactctttgcaccaatggccaagcgcgccacccgcccagaggttcttggcaacctcggaggcttcgcaggactctttgagctcggaaaatacaagaagccaatcctcgcagcaggatctgacggagtcggcaccaagcttgtcatcgcccagatgatggacaagcacgacaccatcggcatcgaccttgttgcaatgtgtgtggatgacctcgttgtcaccggcgcagagccactgttcctccaggactacatcgccatcggcaaggttgtcccagagcacgttgctgagatcgtctccggtatcgcagaaggctgtgtccaggcaggctgtgctctgctcggtggcgaaaccgcagaacacccaggtgttatggaaccagaccactacgatgtctccgcaactgcagtcggcgttgtcgaagcagatgaactgctaggaccagaccgcgtccgcgcaggcgacgtcctcatcggcatggcttcctccggtctgcactccaacggttactccctggctcgccacgtcctcctggaaaaggcaggcctggcgcttgacggacacatcgaagaactcggacgcacccccggtgaagaacttctcgagccaacccgcatgtacgcc

SEQ ID NO: 926 - protein, 268 aa, Corynebacterium glutamicum
LLSPYAWGLSRALLDSYVPNKFQTPAGEAKYTMSDHQDTTAEGVSYAAAGVDIEAGDRAVELFAPMAKRATRPEVLGNLGGFAGLFELGKYKKPILAAGSDGVGTKLVIAQMMDKHDTIGIDLVAMCVDDLVVTGAEPLFLQDYIAIGKVVPEHVAEIVSGIAEGCVQAGCALLGGETAEHPGVMEPDHYDVSATAVGVVEADELLGPDRVRAGDVLIGMASSGLHSNGYSLARHVLLEKAGLALDGHIEELGRTPGEELLEPTRMYA

SEQ ID NO: 927 - DNA, 338 bp, Corynebacterium glutamicum
  CDS (1)..(315): FRXA00770
gtcaccggcggcggcctcgcaggcaacctcgagcgggttgtcccagaagggctcgtcgcagaaatgtcccgagcaacttggaccccaggccaaatcttccgcaccatctcctctgtgggcaaggtttcccgcgaagaaatggaaaagaccttcaacatgggtgtcggcatggttgcagtcgttgctgaaaaggaccgcgaccgcgccctggcaatgctcaccgcacgtcacattgactgctgggaaatcggaaccgtacgcaacggtgaagagggagagcctcgcgtgatcctcaacggcgagcaccctggctactaagcccaactgtctgctctaag

SEQ ID NO: 928 - protein, 105 aa, Corynebacterium glutamicum
VTGGGLAGNLERVVPEGLVAEMSRATWTPGQIFRTISSVGKVSREEMEKTFNMGVGMVAVVAEKDRDRALAMLTARHIDCWEIGTVRNGEEGEPRVILNGEHPGY

SEQ ID NO: 929 - DNA, 1320 bp, Corynebacterium glutamicum
  CDS (101)..(1297): RXN02345
accaccgaccctatgtaatcaaccaggttcccaaggctcgaaaagtggaagcgctgctcaaagatcttacattttggtgaaggcgttatagttaggacttgtgacttctacaggaaaccaagcccacgctccaggaatgcccatcgtcgcagtaattggtgacggccaattagcccgcatgatgcagacctccgccatcgaactcggacaatcactgcgagttctagctggagcgccggattcctccgcagctcaagtagctgctgatgttgttctcggcgattacaccaacattgatgatctgcgcgtcgccatcgaaggcgccgatgtgatgaccttcgaccacgagcacgtccccaacgaacacctgcaccaactcatcgcagaaggcgtcaacgttcagccacgcccagaagcgctggtcaacgcacaagacaaacttgtcatgcgcaagcgtctacgtgaactcggcgcaccagtcccaccatttgctgccattgaatcagtcgaagatgcagtgggattcttcgaagcagttgatggccaagtttgcctcaaagcacgccgtggcggatacgacggcaagggcgtatggttcccagccgatgtagcagagcttcagtcgcttgtggcagagcttctcgacggcggcaccccactcatggcagaaaagaaagttgccctcaacagggaactgtccgccatggttgcccgcaccccaagtggagaaaccaaagcgtggccagtcgtagaatcagtgcagaagaacggtgtgtgtgcagaagcaatcgctcccgcacctgaactatccgcagaactgcaggaatccaccagaggattggcccagaagatcgccacggaactcggcgtcactggtgtcttggcagtggagctttttgaaaccctcgaccaaaacgggcagccagagatctttgtcaacgagctcgccatgcgttcacacaacaccggccactggactcaagatggctgcgtgaccagccaattcgagcagcacctccgcgcagtcctcgactacccactgggtgctaccgacactttggctgattacaccgtgatggccaacgtgctcggtgccgacaccgacccagagatgcccatggcaacccgcatggtggaagtggggcgcaagtacccagatgccaagattcacctctacggcaagggacatcgcccgggacgaaagattggccacgtcaacatggtgggatccgaccttgaaaagacccgagccgaagccctggcctgcgcatacttccttgtcaacgctcgctgggattaggtcttttctgagcgctagca

SEQ ID NO: 930 - protein, 399 aa, Corynebacterium glutamicum
VTSTGNQAHAPGMPIVAVIGDGQLARMMQTSAIELGQSLRVLAGAPDSSAAQVAADVVLGDYTNIDDLRVAIEGADVMTFDHEHVPNEHLHQLIAEGVNVQPRPEALVNAQDKLVMRKRLRELGAPVPPFAAIESVEDAVGFFEAVDGQVCLKARRGGYDGKGVWFPADVAELQSLVAELLDGGTPLMAEKKVALNRELSAMVARTPSGETKAWPVVESVQKNGVCAEAIAPAPELSAELQESTRGLAQKIATELGVTGVLAVELFETLDQNGQPEIFVNELAMRSHNTGHWTQDGCVTSQFEQHLRAVLDYPLGATDTLADYTVMANVLGADTDPEMPMATRMVEVGRKYPDAKIHLYGKGHRPGRKIGHVNMVGSDLEKTRAEALACAYFLVNARWD

SEQ ID NO: 931 - DNA, 833 bp, Corynebacterium glutamicum
  CDS (1)..(810): FRXA02345
tttgctgccattgaatcagtcgaagatgcagtgggattcttcgaagcagttgatggccaagtttgcctcaaagcacgccgtggcggatacgacggcaagggcgtatggttcccagccgatgtagcagagcttcagtcgcttgtggcagagcttctcgacggcggcaccccactcatggcagaaaagaaagttgccctcaacagggaactgtccgccatggttgcccgcaccccaagtggagaaaccaaagcgtggccagtcgtagaatcagtgcagaagaacggtgtgtgtgcagaagcaatcgctcccgcacctgaactatccgcagaactgcaggaatccaccagaggattggcccagaagatcgccacggaactcggcgtcactggtgtcttggcagtggagctttttgaaaccctcgaccaaaacgggcagccagagatctttgtcaacgagctcgccatgcgttcacacaacaccggccactggactcaagatggctgcgtgaccagccaattcgagcagcacctccgcgcagtcctcgactacccactgggtgctaccgacactttggctgattacaccgtgatggccaacgtgctcggtgccgacaccgacccagagatgcccatggcaacccgcatggtggaagtggggcgcaagtacccagatgccaagattcacctctacggcaagggacatcgcccgggacgaaagattggccacgtcaacatggtgggatccgaccttgaaaagacccgagccgaagccctggcctgcgcatacttccttgtcaacgctcgctgggattaggtcttttctgagcgctagca

SEQ ID NO: 932 - protein, 270 aa, Corynebacterium glutamicum
FAAIESVEDAVGFFEAVDGQVCLKARRGGYDGKGVWFPADVAELQSLVAELLDGGTPLMAEKKVALNRELSAMVARTPSGETKAWPVVESVQKNGVCAEAIAPAPELSAELQESTRGLAQKIATELGVTGVLAVELFETLDQNGQPEIFVNELAMRSHNTGHWTQDGCVTSQFEQHLRAVLDYPLGATDTLADYTVMANVLGADTDPEMPMATRMVEVGRKYPDAKIHLYGKGHRPGRKIGHVNMVGSDLEKTRAEALACAYFLVNARWD

SEQ ID NO: 933 - DNA, 618 bp, Corynebacterium glutamicum
  CDS (101)..(595): RXN02350
aagcatttctccaacacttttgatggacagattaacgcttaaaaggcctgttatagactgataaaccgatacgtacttttcgcgcttaaggagaatttcagtgggtcctctagttggtttgatcatgggttcggattcggattgggacactgtagcgccagctgcagaggtactcgctgagtttggcattccttttgaagtcggagttgtctctgcacaccgcaccccagagaagatgctcaactacgcaaagactgcacatgagcgcggcatcaagacgatcatcgcgtgtgctggcggcgctgcacacctgccaggcatggtggctgcagcaactccacttccagtcatcggtgttccacgcgcattgaaggatctcgacggtttggattccttgctgtccatcgtccagatgccaggcggcgttccagtcgccactgtctccatcggtggcgcgaagaatgcaggcctacttgccgttcgtattctcggtgctggtgatccttctttggtcacgaagatggccgattaccaagagaatatggcgaaggaagttgaagccaaggacgaagcactgaagaagcgcttgctcggctaatgaatccgatcgtggtgctg

SEQ ID NO: 934 - protein, 165 aa, Corynebacterium glutamicum
VGPLVGLIMGSDSDWDTVAPAAEVLAEFGIPFEVGVVSAHRTPEKMLNYAKTAHERGIKTIIACAGGAAHLPGMVAAATPLPVIGVPRALKDLDGLDSLLSIVQMPGGVPVATVSIGGAKNAGLLAVRILGAGDPSLVTKMADYQENMAKEVEAKDEALKKRLLG

SEQ ID NO: 935 - DNA, 223 bp, Corynebacterium glutamicum
  CDS (101)..(223): FRXA02346
aagcatttctccaacacttttgatggacagattaacgcttaaaaggcctgttatagactgataaaccgatacgtaactttcgcgcttaaggagaatttcagtgggtcctctagttggtttgatcatgggttcggattcggattgggacactgtagcgccagctgcagaggtactcgctgagtttggcattccttttgaagtcggagttgtctctgcacaccgc

SEQ ID NO: 936 - protein, 41 aa, Corynebacterium glutamicum
VGPLVGLIMGSDSDWDTVAPAAEVLAEFGIPFEVGVVSAHR

SEQ ID NO: 937 - DNA, 252 bp, Corynebacterium glutamicum
  CDS (20)..(229): FRXA02350
atactaggatctcgacggtttggattccttgctgtccatcgtccagatgccaggcggcgttccagtcgccactgtctccatcggtggcgcgaagaatgcaggcctacttgccgttcgtattctcggtgctggtgatccttctttggtcacgaagatggccgattaccaagagaatatggcgaaggaagttgaagccaaggacgaagcactgaagaagcgcttgctcggctaatgaatccgatcgtggtgctg

SEQ ID NO: 938 - protein, 70 aa, Corynebacterium glutamicum
LDSLLSIVQMPGGVPVATVSIGGAKNAGLLAVRILGAGDPSLVTKMADYQENMAKEVEAKDEALKKRLLG

SEQ ID NO: 939 - DNA, 999 bp, Corynebacterium glutamicum
  CDS (101)..(976): RXA01087
ggccttggcagagaactcggccccgaaggtcttgcttcctaccaagaaacccaaaccatttatctctaatccaaactgcacctatatataaggagtaaaaatgcaaacccttgctgctattgttcgtgccacgaagcaaccttttgagatcaccaccattgatctggatgcaccacgaccagatgaagttcaaatccgtgttattgctgccggagtgcgccacactgacgcaattgttcgtgatcagatttacccaacttttcttcccgcagttttcggccacgaaggcgccggagtagttgtcgccgtgggttctgcagtcacctcggtgaaaccagatgacaaggtagtgctgggattcaactcttgtggccagtgcttgaagtgtttgggcggtaagcctgcgtactgtgagaaattctatgaccgcaacttcgcatgcacccgcgatgccgggcacactactttgtttacccgtgcaacaaaagagcaggcagaggccatcatcgacacccttgatgatgttttctacgatgcggatgcgggtttcctggcatacccagcaactcccccagaggcttcgggagtaagcgtgttggttgtcgcggctggtacctctgatctcccccaagcaaaggaagcactacacactgcctcctacttggggcgctccacctcactgattgttgattttggagtggctggcatccaccgcctgctttcatacgaagaagaactccgcgctgcgggcgtgctcatcgttgccgctggaatggatggtgcgctacccggagttgtcgcaggcttagtgtccgcacctgtcgtcgcactgccaacctccgtgggatacggcgcaggtgctggaggaatcgcaccacttctgaccatgcttaacgcctgcgcgccgggagttggagtggtcaacattgataacggctatggagcaggacacctggctgcgcagattgcggcgaggtaagggtttcgcaggagacgaac

SEQ ID NO: 940 - protein, 292 aa, Corynebacterium glutamicum
MQTLAAIVRATKQPFEITTIDLDAPRPDEVQIRVIAAGVRHTDAIVRDQIYPTFLPAVFGHEGAGVVVAVGSAVTSVKPDDKVVLGFNSCGQCLKCLGGKPAYCEKFYDRNFACTRDAGHTTLFTRATKEQAEAIIDTLDDVFYDADAGFLAYPATPPEASGVSVLVVAAGTSDLPQAKEALHTASYLGRSTSLIVDFGVAGIHRLLSYEEELRAAGVLIVAAGMDGALPGVVAGLVSAPVVALPTSVGYGAGAGGIAPLLTMLNACAPGVGVVNIDNGYGAGHLAAQIAAR

SEQ ID NO: 941 - DNA, 1551 bp, Corynebacterium glutamicum
  CDS (101)..(1528): RXA00619
tcaaaggaagacaccattgaaggtgtgcgcaaaatcggagaattcatcaaaaaatagcagcgactaggttagtttcggttcgtggggaataataatttgcgtggctgataaaaagaagatcgcaaacgtcctgtcgaaccgttacgcctccgcggaactttctaacctgtggagtgccgaagagaagatcatcatggagcgccagctctggatcgccgtgatgaaagcccagaaagatttgggagttgagatccctgccgaggcaattgaatcctatgaagcagtgatcgaccaggttgatttggcaagcatcgccgatcgtgagcgcgtcacccgccacgatgtgaaggcccgcatcgaagaattcaatgcactggctggccatgagcacatccacaagggcatgacctcccgcgacctcaccgaaaatgttgaacagctgcagatccaccgctcccttgagctggtccgcaacaagggcattgcagttgttgcagctatcggatcccgcgcagcgcagtaccaaagcctggtcatggctggccgttcccacaacgtggcagcgcaggcaactaccttgggcaagcgtttcgcaaccgcagctgatgaaatgctcgtggcacttgagcgcgtcaccgaactgctcaaccgctacccacttcgcggaatcaagggcccaatgggaaccgcccaagacatgcttgacctcatggaaggcgacgaggctcgtctctccgatctggaaacccgcatcgcagcacacctcggctttgatcgcgtcttcgactccgtcggccaggtctacccacgttcccttgacttcgatgcagtatctgctctggttcagcttggctccggcccatcatcgctgtcccacaccattcgtctcatggccggcaccgaaactgttaccgaaggttttaaggaaggccaggtcggttcctctgcaatgcctcacaagatgaacgctcgctcctgtgagcgcgtgggcggcctgcaggttattcttcgcggatacctcaccatggttgctgatctttccggccagcagtggaacgaaggcgatgtcttctgctccgtgatccgccgcgttgcactgccagacgcattcttcgcgattgacggaatgtttgaaactttcctgacagtcctggatgaattcggtgcattccctgccatgatcgagcgcgaacttgagcgttacctgccattcctggcaactacccgtatcctcatggccgctgtccgcgcaggcgttggccgcgaaaccgcacacgaagtaatcaaggaaaacgctgtcgcggttgccctcaacatgcgcgaaaatggcggtgaccaggaccttatccagcgcctcgctgctgatgagcgcctcccaatgagcgaagctgaccttgaggcagcgctggctgaccgccacgccttcatcggtgccgctgagtcccaggtctcccgtgtgctcgaccgcattcaggtgcttgtcgacgcccaccccggcgccgcagactaccgaccaggtgagattctttaaaggtttttaacggcgttcac

SEQ ID NO: 942 - protein, 476 aa, Corynebacterium glutamicum
VADKKKIANVLSNRYASAELSNLWSAEEKIIMERQLWIAVMKAQKDLGVEIPAEAIESYEAVIDQVDLASIADRERVTRHDVKARIEEFNALAGHEHIHKGMTSRDLTENVEQLQIHRSLELVRNKGIAVVAAIGSRAAQYQSLVMAGRSHNVAAQATTLGKRFATAADEMLVALERVTELLNRYPLRGIKGPMGTAQDMLDLMEGDEARLSDLETRIAAHLGFDRVFDSVGQVYPRSLDFDAVSALVQLGSGPSSLSHTIRLMAGTETVTEGFKEGQVGSSAMPHKMNARSCERVGGLQVILRGYLTMVADLSGQQWNEGDVFCSVIRRVALPDAFFAIDGMFETFLTVLDEFGAFPAMIERELERYLPFLATTRILMAAVRAGVGRETAHEVIKENAVAVALNMRENGGDQDLIQRLAADERLPMSEADLEAALADRHAFIGAAESQVSRVLDRIQVLVDAHPGAADYRPGEIL

SEQ ID NO: 943 - DNA, 1683 bp, Corynebacterium glutamicum
  CDS (101)..(1660): RXA02622
atcaagcaggttgagcgtaaactcattgtagaagtcctgaacagcgtggaattttcgcgtcagggtggcgtacaactcaactggagaggctaaatccttcatgagcgatgatcgtaaggcaattaaacgcgcactaattagcgtgtatgacaagactggcctggaggatctagcccaggcacttcaccgcgagaacgtggaaattgtttccaccggatccactgcggcgaagattgctgagcttggtattcctgttaccccggttgaggagctcaccggtttccctgagtgccttgagggccgtgtgaagacactgcaccctaaggttcacgctggcatcttggcggacacccgcaaggaagaccacctgcgtcagctcaaggaacttgaggtcgccccattccagcttgtcgtggtgaacctgtacccatttgctgagaccgttgcgtccggcgccgatttcgatgcttgcgttgagcagatcgacatcggaggcccatccatggttcgtgctgcggcaaagaaccacccatctgtcgctgtggttgtttcaccgaaccgctacgaggatgtccaggaagctttgaagaccggtggattctcccgcgcggagcgcaccaagttggctgctgaggctttccgccacaccgcaacctacgatgtcaccgttgcaacctggatgagcgagcagctggctgccgaagattctgagactgagttcccaggttggatcggcaccaccaacaccttgtcccgcagcttgcgttacggtgagaaccctcaccagtctgcagctttgtacgtgggcaacacccgcggacttgcacaggctaagcagttccacggcaaggaaatgagctacaacaactacaccgattctgatgctgcatggcgtgcagcgtgggatcacgagcgtccttgtgtagctatcatcaagcatgcaaacccttgtggcattgctgtttctgatgagtccatcgcagcggcacaccgcgaggcacacgcatgtgactctgtgtccgcattcggtggcgtcatcgcgtccaaccgtgaagtcagcgttgagatggctaaccaggttgcagagatcttcactgaggtcatcatcgctccttcctatgaagagggcgctgtggagatcctgagccagaagaagaacatccgtattcttcaggctgaagcacctgtgcgtaagggctttgagtcccgtgagatctccggcggtctgcttgttcaggaacgcgacttgatccacgctgagggcgacaactccgcaaactggactcttgctgccggctctgctgtttctcctgaggttctgaaggacctggagttcgcgtggactgcagttcgttccgtgaagtccaacgcaattctgttggctaagaacggcgctaccgttggcgttggcatgggacaggtcaaccgcgttgactctgctcgcttggctgtcgaccgtgcaggtgcagagcgcgctaccggttccgttgctgcttccgatgcgttcttcccattcgctgatggctttgaggttctcgctgaggctggcatcactgctgttgtgcagcctggtggatccattcgcgacaacgaggtcattgaggcagccaacaaggctggcgtgaccatgtacctgactggtgcgcgacacttcgctcactaaagtttttaaagatttcgctt

SEQ ID NO: 944 - protein, 520 aa, Corynebacterium glutamicum
MSDDRKAIKRALISVYDKTGLEDLAQALHRENVEIVSTGSTAAKIAELGIPVTPVEELTGFPECLEGRVKTLHPKVHAGILADTRKEDHLRQLKELEVAPFQLVVVNLYPFAETVASGADFDACVEQIDIGGPSMVRAAAKNHPSVAVVVSPNRYEDVQEALKTGGFSRAERTKLAAEAFRHTATYDVTVATWMSEQLAAEDSETEFPGWIGTTNTLSRSLRYGENPHQSAALYVGNTRGLAQAKQFHGKEMSYNNYTDSDAAWRAAWDHERPCVAIIKHANPCGIAVSDESIAAAHREAHACDSVSAFGGVIASNREVSVEMANQVAEIFTEVIIAPSYEEGAVEILSQKKNIRILQAEAPVRKGFESREISGGLLVQERDLIHAEGDNSANWTLAAGSAVSPEVLKDLEFAWTAVRSVKSNAILLAKNGATVGVGMGQVNRVDSARLAVDRAGAERATGSVAASDAFFPFADGFEVLAEAGITAVVQPGGSIRDNEVIEAANKAGVTMYLTGARHFAH

SEQ ID NO: 945 - DNA, 1641 bp, Corynebacterium glutamicum
  CDS (101)..(1618): RXN00488
gttgtggaatagcgtgtgagctgcagcggttatccgatttaaggacaagctactaaagtttagataattgtggacacactatgaggaggaactgtcgcacatgacaacccagagccgagtttctaccggaggagacaacccaaacaaggttgcccttgttggattaacctttgatgacgtacttttgcttccagatgcgtcggacgttgttccttcagaggtagatacctcgacgcagttaacacgtaatattcgccttaacacccctattctttctgccgcaatggatactgtcaccgaggctcgcatggctatcggcatggcacgccatggcggcattggtgttttgcaccgcaacctgtctattcaagagcaggcagaaaacgttgagctggtgaagcgttctgagtctggaatggtcactgatcctgttacctgtactcctgacatgagcatccaagaagtggatgatctgtgtgcacgcttccgcatttccggtctgcctgttgttgatgaggccggaaagttggttggtatttgcaccaaccgcgatatgcgttttgaaagcgacatgaaccgtcgtgtcgctgaagttatgaccccaatgcctttggttgttgctgaagagggcgtcaccaaggagcaggctcttgctttgctgtctgcaaacaaggtggagaagcttcctatcatcgcaaaggacggcaagcttgtcggtctgatcacggtgaaggacttcgttaagactgagcagcacccgaacgcatccaaggatgcatcaggtcgtctgctggttgcggctggcatcggcacgggcgaggagtcattccagcgagctggtgcgcttgccgacgccggcgtcgacattttggtcgtagactctgcacacgcccatagccgtggagttttggacatggtgtcccgcgtgaagaagtcgttccccaaggtcgatatcgttggcggcaacttggcgacccgcgaggctgcgcaggccatgattgaagctggcgcagacgctatcaaggtgggtattggcccaggttctatttgcaccactcgcgttgtcgcaggtgtcggtgcacctcagatcactgcgatcatggaggcagctgttccagctcacaaggctggcgttcctatcatcgccgatggcggcatgcagttctctggtgatatcgctaaggctttggctgctggcgctaactccgtgatgctgggctccatgctggctggtaccgctgaggctcctggtgagaccatcaccatcaacggcaagcagtacaagcgttaccgcggcatgggctccatgggcgctatgcagggccgtggacttagtggtgagaagcgttcctactccaaggaccgttacttccagtctgacgttaagagcgaagacaagctcgttccagaaggcatcgaaggtcgcgtgcctttccgcggtcccatcggagacatcattcaccagcaggtcggtggacttcgtgcagcaatgggctacaccggttcctccaccattgaagagctgcacaacgctcgtttcgtgcagatcaccagcgcgggtctgaaggaatcccacccgcaccacatccagcagactgtggaagctcctaactaccactagattttgctcacttaaacagc

SEQ ID NO: 946 - protein, 506 aa, Corynebacterium glutamicum
MTTQSRVSTGGDNPNKVALVGLTFDDVLLLPDASDVVPSEVDTSTQLTRNIRLNTPILSAAMDTVTEARMAIGMARHGGIGVLHRNLSIQEQAENVELVKRSESGMVTDPVTCTPDMSIQEVDDLCARFRISGLPVVDEAGKLVGICTNRDMRFESDMNRRVAEVMTPMPLVVAEEGVTKEQALALLSANKVEKLPIIAKDGKLVGLITVKDFVKTEQHPNASKDASGRLLVAAGIGTGEESFQRAGALADAGVDILVVDSAHAHSRGVLDMVSRVKKSFPKVDIVGGNLATREAAQAMIEAGADAIKVGIGPGSICTTRVVAGVGAPQITAIMEAAVPAHKAGVPIIADGGMQFSGDIAKALAAGANSVMLGSMLAGTAEAPGETITINGKQYKRYRGMGSMGAMQGRGLSGEKRSYSKDRYFQSDVKSEDKLVPEGIEGRVPFRGPIGDIIHQQVGGLRAAMGYTGSSTIEELHNARFVQITSAGLKESHPHHIQQTVEAPNYH

SEQ ID NO: 947 - DNA, 574 bp, Corynebacterium glutamicum
  CDS (101)..(574): FRXA00492
gttgtggaatagcgtgtgagctgcagcggttatccgatttaaggacaagctactaaagtttagataattgtggacacactatgaggaggaactgtcgcacatgacaacccagagccgagtttctaccggaggagacaacccaaacaaggttgcccttgttggattaacctttgatgacgtacttttgcttccagatgcgtcggacgttgttccttcagaggtagatacctcgacgcagttaacacgtaatattcgccttaacacccctattctttctgccgcaatggatactgtcaccgaggctcgcatggctatcggcatggcacgccatggcggcattggtgttttgcaccgcaacctgtctattcaagagcaggcagaaaacgttgagctggtgaagcgttctgagtctggaatggtcactgatcctgttacctgtactcctgacatgagcatccaagaagtggatgatctgtgtgcacgcttccgcatttccggtctgcctgttgttgatgaggccggaaagttggttggtatttgcaccaaccgcgatatgcgttttgaaagcgacatg

SEQ ID NO: 948 - protein, 158 aa, Corynebacterium glutamicum
MTTQSRVSTGGDNPNKVALVGLTFDDVLLLPDASDVVPSEVDTSTQLTRNIRLNTPILSAAMDTVTEARMAIGMARHGGIGVLHRNLSIQEQAENVELVKRSESGMVTDPVTCTPDMSIQEVDDLCARFRISGLPVVDEAGKLVGICTNRDMRFESDM

SEQ ID NO: 949 - DNA, 557 bp, Corynebacterium glutamicum
  CDS (1)..(534): FRXA00488
cagatcactgcgatcatggaggcagctgttccagctcacaaggctggcgttcctatcatcgccgatggcggcatgcagttctctggtgatatcgctaaggctttggctgctggcgctaactccgtgatgctgggctccatgctggctggtaccgctgaggctcctggtgagaccatcaccatcaacggcaagcagtacaagcgttaccgcggcatgggctccatgggcgctatgcagggccgtggacttagtggtgagaagcgttcctactccaaggaccgttacttccagtctgacgttaagagcgaagacaagctcgttccagaaggcatcgaaggtcgcgtgcctttccgcggtcccatcggagacatcattcaccagcaggtcggtggacttcgtgcagcaatgggctacaccggttcctccaccattgaagagctgcacaacgctcgtttcgtgcagatcaccagcgcgggtctgaaggaatcccacccgcaccacatccagcagactgtggaagctcctaactaccactagattttgctcacttaaacagc

SEQ ID NO: 950 - protein, 178 aa, Corynebacterium glutamicum
QITAIMEAAVPAHKAGVPIIADGGMQFSGDIAKALAAGANSVMLGSMLAGTAEAPGETITINGKQYKRYRGMGSMGAMQGRGLSGEKRSYSKDRYFQSDVKSEDKLVPEGIEGRVPFRGPIGDIIHQQVGGLRAAMGYTGSSTIEELHNARFVQITSAGLKESHPHHIQQTVEAPNYH

SEQ ID NO: 951 - DNA, 1554 bp, Corynebacterium glutamicum
  CDS (101)..(1531): RXA02469
cgtcgaaaagcagtagtaaagcagcaggaaggtggtggaaagagcaattgaggtacccttgccgtgttcagggataactgattaatcaactaggagacccatgcgttttcttaacaattccaatccgccctatgagctgacatattccgatgtgtttatggtgccttcgcgttctgacgtaggctcccgcatgtccgtggatctgcgcaccaatgacggaactggaacaaccatcccgctcgttgtggcaaacatgactgctgttgctggccgacgcatggctgagaccattgcgcgccgcggtggcatggcgattcttccgcaggatgtgcccgccgatattgctgcagagactatcgcgaatgtgaagaaagcggacctggtttttgataccccaattaccgtaaaaccgcaccacaccgtgggttatgcacgcaacttgatccacaagcgtgcgcacggtgcagccattgttttggagggcgatcagccggtcggcatcgtcaccgacaaggacctcgaaggcgcagacaacttcactcaggtgggcaccctcatgtccacctccctattgacgctgcctgaggatatttcccccgaagacgccttcggaatcctccacgaacacagccgcaaactcgcccccgtcgtcgcggctgacggctcactccgcggcatcctcacccgcaccggcgccctgcgcgccaccatgtacaagccggctatcgacgccaacggccgcctgcgagtcggcgccgccatcggcatcaacggcgacatcgaaggacgcaccaaaacgcttctcgacgccggcgccgacgttctagtcgtcgacacagcacacggccaccaatccaccatgatcagcgccctcaaacgcatccgcgcactcgacgtcaacgtccccatcgttgctggcaacgtggtcaccgccgatggtgtccgcgacctagttgaagcaggcgcaaacatcatcaaggtaggcgttggaccaggcgcaatgtgcaccacccgcatgcaaaccggcgttggccgaccacagttctccgcagtgctggaatgcgcagccgaagcccgcaaactcggcgcacacgtatgggcagacggcggagtccgcgacccccgcgacgtcgccctggcactcgcagctggcgcctccaacgtgatggtcggatcctggttctccggaacctacgaatcccccggcgacctccgcttcgaatccgacggacgcatgtacaaagaatccttcggtatggcatcccggcgcgccgtggaaagccgaaaccaaaaggtcgaagctttcgaaaaagcacgccgcgcaatgttcgaagaaggcatctccactgcccgcatctacattgacaaacgccacggcggagtcgaggacctggtagatcaaatcatctccggtgtccgctcctcattcacctacgcaggcgccgattcgattgaaaccttcttcgaacgcgccaccgtcggagttcaatccaccgaaggctacgcagaaggaaagccacgcgcttcgcgttaagtgttgttgtgcctttgaga

SEQ ID NO: 952 - protein, 477 aa, Corynebacterium glutamicum
MRFLNNSNPPYELTYSDVFMVPSRSDVGSRMSVDLRTNDGTGTTIPLVVANMTAVAGRRMAETIARRGGMAILPQDVPADIAAETIANVKKADLVFDTPITVKPHHTVGYARNLIHKRAHGAAIVLEGDQPVGIVTDKDLEGADNFTQVGTLMSTSLLTLPEDISPEDAFGILHEHSRKLAPVVAADGSLRGILTRTGALRATMYKPAIDANGRLRVGAAIGINGDIEGRTKTLLDAGADVLVVDTAHGHQSTMISALKRIRALDVNVPIVAGNVVTADGVRDLVEAGANIIKVGVGPGAMCTTRMQTGVGRPQFSAVLECAAEARKLGAHVWADGGVRDPRDVALALAAGASNVMVGSWFSGTYESPGDLRFESDGRMYKESFGMASRRAVESRNQKVEAFEKARRAMFEEGISTARIYIDKRHGGVEDLVDQIISGVRSSFTYAGADSIETFFERATVGVQSTEGYAEGKPRASR

SEQ ID NO: 953 - DNA, 1692 bp, Corynebacterium glutamicum
  CDS (101)..(1669): RXN00487
agggcgccaggggcatccagccattaaagcttttcgacgagccctcgcccatgtggccaaagaatcttatttggaggctcgtctagtagagtgagttcttgtgagccttcagacaaatcatcgcccagtactcgtcgttgacttcggcgcacagtacgcgcagctgatcgcacgtcgtgtgcgtgaggccggcatctactccgaagtcatcccgcacaccgccaccgcagacgatgtgcgcgctaaaaatgcagcagccctcgtcctttccggtggcccatcctccgtgtatgccgagggagcaccatcccttgacgctgagattcttgatctcggattgccagtatttggcatttgctacggcttccaagccatgacccacgcgcttggtggcaccgttgccaacaccggtaagcgcgaatacggacgcaccgacatcaacgttgccggtggcgtcctccacgaaggcctcgaagcctgccacaaggtgtggatgagccacggcgacgccgtctctgaagccccagaaggtttcgtagtcaccgcgtcctccgaaggtgcgcctgtcgcagctttcgaaaacaaggaacgcaaaatggctggcgtgcagtaccacccagaggtattgcactcaccacacggccaggcagttctgacccgcttcctcactgagatcgcaggtctagagcagaactggaccgcagcaaacatcgctgaagaactcatcgaaaaggtccgcgagcagatcggcgaagatggccgcgctatttgtggcctatccggtggtgtggactccgctgttgccggtgctttggtgcagcgcgccattggtgaccgtttgacctgtgtctttgttgaccacggtctgctgcgtgccggtgagcgcgagcaggtggaaaaagacttcgtcgcagcaaccggcgccaagctggttaccgttgatgagcgccaggcattcctatccaagctggccggagttaccgaaccagaagcaaagcgcaaggctatcggcgctgagttcatccgctccttcgagcgcgcagttgccggtgtgctggaagaagctccagaaggttccaccgtggacttcctggttcagggcaccctgtacccagacgtcgtggaatccggtggtggatctggtaccgcaaacatcaagagccaccacaacgtcggtggactgccagacgatgtggaattcaagcttgttgagccactgcgtgacctcttcaaagacgaagtccgtgccgttggccgtgaacttggcctgcctgaggaaatcgttggccgccagccattcccaggaccaggacttggtatccgcatcatcggtgaagtcaccgaagatcgcctagaaaccctccgccacgctgacctgatcgcccgcaccgagctcaccgaagccggacttgacggcgtgatctggcagtgcccagtagtcctcctggcagatgtccgctctgttggtgttcaaggcgatggccgcacctacggacacccaatcgtgctgcgcccagtgtcttccgaagacgcaatgaccgccgactggacccgcctgccatacgaggttctggagaagatctccacccgcatcaccaacgaagttccagatgtgaaccgcgtggtgctggacgtaacctccaagccaccaggaaccatcgaatgggagtaggccttaaatgagccttcgtt

SEQ ID NO: 954 - protein, 523 aa, Corynebacterium glutamicum
VSLQTNHRPVLVVDFGAQYAQLIARRVREAGIYSEVIPHTATADDVRAKNAAALVLSGGPSSVYAEGAPSLDAEILDLGLPVFGICYGFQAMTHALGGTVANTGKREYGRTDINVAGGVLHEGLEACHKVWMSHGDAVSEAPEGFVVTASSEGAPVAAFENKERKMAGVQYHPEVLHSPHGQAVLTRFLTEIAGLEQNWTAANIAEELIEKVREQIGEDGRAICGLSGGVDSAVAGALVQRAIGDRLTCVFVDHGLLRAGEREQVEKDFVAATGAKLVTVDERQAFLSKLAGVTEPEAKRKAIGAEFIRSFERAVAGVLEEAPEGSTVDFLVQGTLYPDVVESGGGSGTANIKSHHNVGGLPDDVEFKLVEPLRDLFKDEVRAVGRELGLPEEIVGRQPFPGPGLGIRIIGEVTEDRLETLRHADLIARTELTEAGLDGVIWQCPVVLLADVRSVGVQGDGRTYGHPIVLRPVSSEDAMTADWTRLPYEVLEKISTRITNEVPDVNRVVLDVTSKPPGTIEWE

SEQ ID NO: 955 - DNA, 1486 bp, Corynebacterium glutamicum
  CDS (101)..(1486): FRXA00487
agggcgccaggggcatccagccattaaagcttttcgacgagccctcgcccatgtggccaaagaatcttatttggaggctcgtctagtagagtgagttcttgtgagccttcagacaaatcatcgcccagtactcgtcgttgacttcggcgcacagtacgcgcagctgatcgcacgtcgtgtgcgtgaggccggcatctactccgaagtcatcccgcacaccgccaccgcagacgatgtgcgcgctaaaaatgcagcagccctcgtcctttccggtggcccatcctccgtgtatgccgagggagcaccatcccttgacgctgagattcttgatctcggattgccagtatttggcatttgctacggcttccaagccatgacccacgcgcttggtggcaccgttgccaacaccggtaagcgcgaatacggacgcaccgacatcaacgttgccggtggcgtcctccacgaaggcctcgaagcctgccacaaggtgtggatgagccacggcgacgccgtctctgaagccccagaaggtttcgtagtcaccgcgtcctccgaaggtgcgcctgtcgcagctttcgaaaacaaggaacgcaaaatggctggcgtgcagtaccacccagaggtattgcactcaccacacggccaggcagttctgacccgcttcctcactgagatcgcaggtctagagcagaactggaccgcagcaaacatcgctgaagaactcatcgaaaaggtccgcgagcagatcggcgaagatggccgcgctatttgtggcctatccggtggtgtggactccgctgttgccggtgctttggtgcagcgcgccattggtgaccgtttgacctgtgtctttgttgaccacggtctgctgcgtgccggtgagcgcgagcaggtggaaaaagacttcgtcgcagcaaccggcgccaagctggttaccgttgatgagcgccaggcattcctatccaagctggccggagttaccgaaccagaagcaaagcgcaaggctatcggcgctgagttcatccgctccttcgagcgcgcagttgccggtgtgctggaagaagctccagaaggttccaccgtggacttcctggttcagggcaccctgtacccagacgtcgtggaatccggtggtggatctggtaccgcaaacatcaagagccaccacaacgtcggtggactgccagacgatgtggaattcaagcttgttgagccactgcgtgacctcttcaaagacgaagtccgtgccgttggccgtgaacttggcctgcctgaggaaatcgttggccgccagccattcccaggaccaggacttggtatccgcatcatcggtgaagtcaccgaagatcgcctagaaaccctccgccacgctgacctgatcgcccgcaccgagctcaccgaagccggacttgacggcgtgatctggcagtgcccagtagtcctcctggcagatgtccgctctgttggtgttcaaggcgatggccgc

SEQ ID NO: 956 - protein, 462 aa, Corynebacterium glutamicum
VSLQTNHRPVLVVDFGAQYAQLIARRVREAGIYSEVIPHTATADDVRAKNAAALVLSGGPSSVYAEGAPSLDAEILDLGLPVFGICYGFQAMTHALGGTVANTGKREYGRTDINVAGGVLHEGLEACHKVWMSHGDAVSEAPEGFVVTASSEGAPVAAFENKERKMAGVQYHPEVLHSPHGQAVLTRFLTEIAGLEQNWTAANIAEELIEKVREQIGEDGRAICGLSGGVDSAVAGALVQRAIGDRLTCVFVDHGLLRAGEREQVEKDFVAATGAKLVTVDERQAFLSKLAGVTEPEAKRKAIGAEFIRSFERAVAGVLEEAPEGSTVDFLVQGTLYPDVVESGGGSGTANIKSHHNVGGLPDDVEFKLVEPLRDLFKDEVRAVGRELGLPEEIVGRQPFPGPGLGIRIIGEVTEDRLETLRHADLIARTELTEAGLDGVIWQCPVVLLADVRSVGVQGDGR

SEQ ID NO: 957 - DNA, 693 bp, Corynebacterium glutamicum
  CDS (101)..(670): RXA02237
gacgagctgggcattgctcagacccgtcgtcttcgtggactgggtgaccgtcagcgtcgcgcacttctcgagcgtttcggcttcgaggattaattcttcagtgtcgggcgataaccaactaggacggctcgtaattcttgcgggcccctcagcggtcggtaaatcgactgtggttgatcgcctccgcaatgacgttccaaacctgtatttcagtgtgtcgatgaccactagggcacctcgtcctggtgaagtcgatggacgtgactacttctatgtcactgcacaggaatttcaggacaaaatcgactgtggagagatgcttgaatgggcagatatccacggcggtttgcagcgttcaggcactccagcaggtcccgtcaatgaggctcgccaaaatggtcggccagtattggttgaggttgatcttgcaggagcccgaaacatcgctagcttaattccagatgcagaaaccatcttccttgctccaccttcatgggaagttttggttgaacgcctcactggacgtggcaccgaaagcgaagacgttattgctcgcaggctcgagaccgcacgcgaagaattggctgctcagagcgaatttaagcacgtcattatcaatgatgatgtggatacagccgtcaaggctattgaggatgttctcctcggcgcttagccaaaacatagagcggtagg

SEQ ID NO: 958 - protein, 190 aa, Corynebacterium glutamicum
VSGDNQLGRLVILAGPSAVGKSTVVDRLRNDVPNLYFSVSMTTRAPRPGEVDGRDYFYVTAQEFQDKIDCGEMLEWADIHGGLQRSGTPAGPVNEARQNGRPVLVEVDLAGARNIASLIPDAETIFLAPPSWEVLVERLTGRGTESEDVIARRLETAREELAAQSEFKHVIINDDVDTAVKAIEDVLLGA

SEQ ID NO: 959 - DNA, 1413 bp, Corynebacterium glutamicum
  CDS (101)..(1390): RXA01446
gatgattaaaaacctcacatgggatagtaagatgaaataacgtctgtgtgcgcacacgcgtgcatactccaacttcatggatcggatgtgacgtaaaccaatggctgcaatcgttattgtcggcgctcaatggggcgatgaaggcaaaggtaaggccacggatattctcggcggactcgtcgattacgtggttaagcccaatggcggtaacaacgctggacacactgttgtggtcggcggcgagaagtacgagctaaagctccttcctgccggcgtcctctccgaaacggccaccccaattttgggcaacggcgttgtgatcaaccttgaggcactgttcgaagaaatcgacggccttgaggctcgcggtgcggatgcatcccgcctgcgcatctctgcaaacgctcacctggttgctccataccaccaggtgatggaccgtgttcaggaacgcttcctgggcaagcgcgcaatcggcaccaccggccgtggcatcggcccaacctacgcggacaaagtatcccgcgtgggaatccgtgttcaagacattttcgacgaatccatccttcgtcaaaaagtcgaatccgccctggattacaaaaaccaggtgctggtgaagatgtacaaccgcaaggccatcgtcgctgaggaaatcgtgcagtacttcctctcctacgctgatcgtctgcgccccatggtcatcgatgccaccttggtgctcaacgaggcacttgatcagggcaagcacgttcttatggaaggtggccaggcaaccatgctcgacgtggaccacggcacctacccattcgtcacctcctccaacccaaccgccggtggcgcaagtgttggttcaggtatcggcccaaccaagatcaccagctccttgggtatcatcaaggcctacaccactcgtgttggtgccggcccattcccaactgagctgtttgataagtggggcgagtacctgcagaccgtcggtggcgaggtcggcgtgaacaccggccgtaagcgtcgctgtggctggtacgactccgtgattgctcgttacgcatcccgcgtcaacggattcaccgactacttcctgaccaagctagacgtgctcaccggcatcggtgaaatcccaatctgcgtagcttacgacgttgatggtgttcgccacgatgaaatgccactgacccagtcagagttccaccacgcaaccccaatctttgaaaccatgcctgcatgggacgaagacatcaccgactgcaagaccttcgaggatcttccacaaaaggcccaggactacgtccgacgtctggaagaactctctggtgctcgcttctcctacatcggtgttggacctggtcgcgatcagaccatcgtcctgcatgacgtactagctgacaactagtactgataaacatcagtgag

SEQ ID NO: 960 - protein, 430 aa, Corynebacterium glutamicum
MAAIVIVGAQWGDEGKGKATDILGGLVDYVVKPNGGNNAGHTVVVGGEKYELKLLPAGVLSETATPILGNGVVINLEALFEEIDGLEARGADASRLRISANAHLVAPYHQVMDRVQERFLGKRAIGTTGRGIGPTYADKVSRVGIRVQDIFDESILRQKVESALDYKNQVLVKMYNRKAIVAEEIVQYFLSYADRLRPMVIDATLVLNEALDQGKHVLMEGGQATMLDVDHGTYPFVTSSNPTAGGASVGSGIGPTKITSSLGIIKAYTTRVGAGPFPTELFDKWGEYLQTVGGEVGVNTGRKRRCGWYDSVIARYASRVNGFTDYFLTKLDVLTGIGEIPICVAYDVDGVRHDEMPLTQSEFHHATPIFETMPAWDEDITDCKTFEDLPQKAQDYVRRLEELSGARFSYIGVGPGRDQTIVLHDVLADN

SEQ ID NO: 961 - DNA, 1551 bp, Corynebacterium glutamicum; identical to SEQ ID NO: 941
  CDS (101)..(1528): RXA00619

SEQ ID NO: 962 - protein, 476 aa, Corynebacterium glutamicum; identical to SEQ ID NO: 942

SEQ ID NO: 963 - DNA, 666 bp, Corynebacterium glutamicum
  CDS (101)..(643): RXA00688
gcggaaccgcaatcttgattcttgtatctgttgcactgaccacagtgaagcagattgagagccagctcctgcaaagcaactacgaaggacttctaaaataatgcgactcgtactcctcggacctcccggtgctggtaagggcacccaggctgcaattctctctgagaagcttggcattcctcacatttctactggcgatcttttccgcgccaacattggcgaaggtacccctctgggtatcgaggccaagcagtacatcgacgctggcaagctggttccaaccgacgtgactgcacgtatggttgcttcccgccttgctgagtccgatgctgcagaaggcttccttttggatggtttcccacgcaccgttgagcaggctgacatcttggctaacctgctttccgaagctggccagaccctcgatggtgttgttaactaccaggtttctgaagacgtcgtcgtggagcgcatgctgtcccgtggtcgcgctgatgacaacgaagagaccatccgcacccgtctcggtgtctaccgcgacgagactgctcctctgatcgatcactacggtgacaagatcatcaacattgaggctgaaggcgaagtcgaagagatcaacgctcgtaccctcaaggcactgggcaaataagatttcttctctagtgctgc

SEQ ID NO: 964 - protein, 181 aa, Corynebacterium glutamicum
MRLVLLGPPGAGKGTQAAILSEKLGIPHISTGDLFRANIGEGTPLGIEAKQYIDAGKLVPTDVTARMVASRLAESDAAEGFLLDGFPRTVEQADILANLLSEAGQTLDGVVNYQVSEDVVVERMLSRGRADDNEETIRTRLGVYRDETAPLIDHYGDKIINIEAEGEVEEINARTLKALGK

SEQ ID NO: 965 - DNA, 531 bp, Corynebacterium glutamicum
  CDS (101)..(508): RXA00266
agtaggggatcgtccagcgaagcggtcgcagaggctgtgaggaagctctaagtcgacttaagtgcgcgaagcagaccaccattaggtagaatcacccaacatgactgaacgtactctcatccttatcaagccagacggtgttaccaacggacacgtcggcgaaatcatcgcacgtattgagcgcaagggcctgaagctcgctgctctggatctgcgtgttgcagaccgcgagaccgctgaaaagcactacgaagagcacgctgacaagccattcttcggtgagctcgttgaattcatcacctctgcacctctgatcgcaggcatcgtcgaaggcgagcgtgcaatcgatgcatggcgtcagcttgctggtggcaccgacccagttgctaaggcaaccccaggcaccatccgcggcgatttcgcactgactgttggagagaacgttgttcacggttctgattccccagagtccgctgagcgcgagatctccatctggttccctaacctgtaatttttacggttagaaaaaaa

SEQ ID NO: 966 - protein, 136 aa, Corynebacterium glutamicum
MTERTLILIKPDGVTNGHVGEIIARIERKGLKLAALDLRVADRETAEKHYEEHADKPFFGELVEFITSAPLIAGIVEGERAIDAWRQLAGGTDPVAKATPGTIRGDFALTVGENVVHGSDSPESAEREISIWFPNL

SEQ ID NO: 967 - DNA, 1245 bp, Corynebacterium glutamicum
  CDS (101)..(1222): RXA00489
cagcccgatttcttcattgaaatcgggctgtttctggttgtgtcgcgtatctcgggtaaagtcttcgtcgtatacgaccatttaagggaggcccgtcacaatgcgtgaccacgttgaaatcggtatcggccgtgaggcacgacgcacctacagcttggacgatatttctgtcgtttctagccgccgcacccgttcatccaaagatgtcgacaccacttggcatattgacgcctacaagtttgatctgccgttcatgaatcacccaagtgatgcattggcaagccctgagtttgtcattgaaatgggcaagcagggtggccttggcgtgatcaacgctgagggtctgtggggtcgccatgctgatctcgatgaggcgatcgcaaaggtgattgctgcgtatgaggaaggcgaccaggctgcagccactcgcactcttcaggagctgcacgcagcgccactggatactgagctgctgagtgagcgcattgcgcaggttcgtgattccggtgagatcgttgctgtgcgcgtgtctccacaaaatgttcgtgagatcgcaccaatcgtcatcaaggcaggtgctgatctgctggttatccagggcaccctgatctctgcagagcacgtcaacaccggtggagaggccctgaacctaaaggaattcatcggttctttggatgttcctgtcatcgctggtggcgtgaacgattacaccaccgcgttgcacatgatgcgtaccggtgctgtgggcatcatcgtcggtggcggcgagaacaccaacagcctagcattgggcatggaggtatccatggccactgcgattgctgatgtcgctgcggcacgtcgtgattacctggatgagaccggtggacgttacgtgcacatcattgcagatggaagcattgaaaactccggtgatgtagtcaaggctattgcctgtggcgcagatgctgtggtgctgggttcaccgttggctcgcgctgaagaagctgctggaaagggctacttctggccagcagtggcagcgcaccctcgtttcccacgcggtgtggttactgagtccgtggacttggatgaggcagcaccaagcttggagcagattctgcatggtccgtctacgatgccgtggggtgtggaaaacttcgaaggtggattaaagcgtgcgctggctaagtgtggctacaccgatttgaagagcttccaaaaggtaagcctgcacgttaactaggtgtgtgtactcgcctcttc

SEQ ID NO: 968 - protein, 374 aa, Corynebacterium glutamicum
MRDHVEIGIGREARRTYSLDDISVVSSRRTRSSKDVDTTWHIDAYKFDLPFMNHPSDALASPEFVIEMGKQGGLGVINAEGLWGRHADLDEAIAKVIAAYEEGDQAAATRTLQELHAAPLDTELLSERIAQVRDSGEIVAVRVSPQNVREIAPIVIKAGADLLVIQGTLISAEHVNTGGEALNLKEFIGSLDVPVIAGGVNDYTTALHMMRTGAVGIIVGGGENTNSLALGMEVSMATAIADVAAARRDYLDETGGRYVHIIADGSIENSGDVVKAIACGADAVVLGSPLARAEEAAGKGYFWPAVAAHPRFPRGVVTESVDLDEAAPSLEQILHGPSTMPWGVENFEGGLKRALAKCGYTDLKSFQKVSLHVN

SEQ ID NO: 969 - DNA, 1545 bp, Corynebacterium glutamicum
  CDS (101)..(1531): RXN02281
aagatcaacaacgccgccgaggtcaacttggaaattatcacgtgaggattcttgcatacgcctataaaagcacagttttgaatccacagggcatcagggcgtgcagaaagatagtgtggtgcgcatggaagcaacaacgatcgatgacgcaatcgcgaagctcattgacatctacgacacctcgaccaaactggccaaagaaaccctcaacaatgaggactacgccgcatacgccgatgttgtttaccccaaactcaccgttgacgtgctggaatggaaacccatcgaccgcaccgaacccttcggctatgtggatcgagccgggcgatactccgccaccttgtccaaaccacgcgtgattgagcgttacctccgcgaacaactcgagcgtctcaccagtaattatccctgcaagatttacgtatctgagtcagatatccgcatcccaccggagtacattcgcggcgcaccttccgctaccgaagctcgccgtgctggtgatgttgcagatatcatcccacgccccaccctggatgaagtccacgacgcaattatcgacggcgactggcacgccttcaacggccccgaactcccgcttttccacttcgggccgcaacgcttcgacatcgcctgcgcccgcatcgagcactacaccggcatcaacgtggaacacgtgcagaagtacattctgttcaccaactacgccatgcacaccaccgagttcgtgcattttgccatgtccgaactcacctcggaagactcccgctacgtgggtctatccttgccaaacgggcaggtaattgaccgagagaccgccaccagcctcggtacggaaacccttgatctgactagccgtttccaaatgcctcgttacgatctcatcaccgaagccggtgacggtattaccattatcaacatcggtgtgggcccatccaatgcaaaaactatcaccgactgccttgctgtgctccgcccagaagcctgggtgatgatcggccactgtgctggcatggacgcccgcatgcgcatcggcgacctcatccttggcaacgcctaccagcgcgaagaccacattctgaatacccgcatcccacttggtaatccgatcccggcaataccagaaatccaaaaagctctagaagccagcgtcgacgaaatctacggatccgacaacagcctcatgcgcaccggtacggtcttatccaccgacgaccgaaactgggaatggcacaccccagaaaacctctggaactggctcaaaggatccaccgccgcagctgttgacatggaatcttccaccttggccaccaacggatatcgattccgcattccatacggcaccctgctgagcgtctctgacctgccactacacgcagtgccgaaactttccgcgcaagcgcaggcgttttacttcaactccaaggaagcccacgtcatgtgtgctgttcgtgcaatggaatacctggcagtagatcctgaacggttgcgtacccgtaaactgcgcaggaccttgggtgaggtgccgtttcgctaaagtctcggaga

SEQ ID NO: 970 - protein, 477 aa, Corynebacterium glutamicum
VQKDSVVRMEATTIDDAIAKLIDIYDTSTKLAKETLNNEDYAAYADVVYPKLTVDVLEWKPIDRTEPFGYVDRAGRYSATLSKPRVIERYLREQLERLTSNYPCKIYVSESDIRIPPEYIRGAPSATEARRAGDVADIIPRPTLDEVHDAIIDGDWHAFNGPELPLFHFGPQRFDIACARIEHYTGINVEHVQKYILFTNYAMHTTEFVHFAMSELTSEDSRYVGLSLPNGQVIDRETATSLGTETLDLTSRFQMPRYDLITEAGDGITIINIGVGPSNAKTITDCLAVLRPEAWVMIGHCAGMDARMRIGDLILGNAYQREDHILNTRIPLGNPIPAIPEIQKALEASVDEIYGSDNSLMRTGTVLSTDDRNWEWHTPENLWNWLKGSTAAAVDMESSTLATNGYRFRIPYGTLLSVSDLPLHAVPKLSAQAQAFYFNSKEAHVMCAVRAMEYLAVDPERLRTRKLRRTLGEVPFR

SEQ ID NO: 971 - DNA, 1191 bp, Corynebacterium glutamicum
  CDS (101)..(1168): FRXA02281
aagatcaacaacgccgccgaggtcaacttggaaattatcacgtgaggattcttgcatacgcctataaaagcacagttttgaatccacagggcatcagggcgtgcagaaagatagtgtggtgcgcatggaagcaacaacgatcgatgacgcaatcgcgaagctcattgacatctacgacacctcgaccaaactggccaaagaaaccctcaacaatgaggactacgccgcatacgccgatgttgtttaccccaaactcaccgttgacgtgctggaatggaaacccatcgaccgcaccgaacccttcggctatgtggatcgagccgggcgatactccgccaccttgtccaaaccacgcgtgattgagcgttacctccgcgaacaactcgagcgtctcaccagtaattatccctgcaagatttacgtatctgagtcagatatccgcatcccaccggagtacattcgcggcgcaccttccgctaccgaagctcgccgtgctggtgatgttgcagatatcatcccacgccccaccctggatgaagtccacgacgcaattatcgacggcgactggcacgccttcaacggccccgaactcccgcttttccacttcgggccgcaacgcttcgacatcgcctgcgcccgcatcgagcactacaccggcatcaacgtggaacacgtgcagaagtacattctgttcaccaactacgccatgcacaccaccgagttcgtgcattttgccatgtccgaactcacctcggaagactcccgctacgtgggtctatccttgccaaacgggcaggtaattgaccgagagaccgccaccagcctcggtacggaaacccttgatctgactagccgtttccaaatgcctcgttacgatctcatcaccgaagccggtgacggtattaccattatcaacatcggtgtgggcccatccaatgcaaaaactatcaccgactgccttgctgtgctccgcccagaagcctgggtgatgatcggccactgtgctggcatggacgcccgcatgcgcatcggcgacctcatccttggcaacgcctaccagcgcgaagaccacattctgaatacccgcatcccacttggtaatccgatcccggcaataccagaaatccaaaaagctctagaagccagcgtcgacgaaatctacggatcctagtattctatagtgtcacctaa

SEQ ID NO: 972 - protein, 356 aa, Corynebacterium glutamicum
VQKDSVVRMEATTIDDAIAKLIDIYDTSTKLAKETLNNEDYAAYADVVYPKLTVDVLEWKPIDRTEPFGYVDRAGRYSATLSKPRVIERYLREQLERLTSNYPCKIYVSESDIRIPPEYIRGAPSATEARRAGDVADIIPRPTLDEVHDAIIDGDWHAFNGPELPLFHFGPQRFDIACARIEHYTGINVEHVQKYILFTNYAMHTTEFVHFAMSELTSEDSRYVGLSLPNGQVIDRETATSLGTETLDLTSRFQMPRYDLITEAGDGITIINIGVGPSNAKTITDCLAVLRPEAWVMIGHCAGMDARMRIGDLILGNAYQREDHILNTRIPLGNPIPAIPEIQKALEASVDEIYGS

SEQ ID NO: 973 - DNA, 1302 bp, Corynebacterium glutamicum; identical to SEQ ID NO: 355
  CDS (101)..(1279): RXA00147

SEQ ID NO: 974 - protein, 393 aa, Corynebacterium glutamicum; identical to SEQ ID NO: 356

SEQ ID NO: 975 - DNA, 1059 bp, Corynebacterium glutamicum
  CDS (101)..(1036): RXA00145
ccccaccgcacgcgcggaagacgtttccgtcatgcttacagaaatcgacggccgcgatgcagtcacgctcacccgagaagactctgaaggggattcctagatgaagcacctcctatccattagcgatctttccaaagatgagattgttggattgctggatgaagcggatcgctttaaggaggtgctcgaaggacgtgaagtaaagaagctgcccacgctgcgtggtcgcaccatttttaccttgttctatgagaactccacgcgcacccgttcgtcctttgaaaccgcaggaaagtggatgagcgccgatgtgattaacatttcggcctcatcatccagcgtgaagaagggcgagtcgctgaaagataccggcttgactttgtcggcaatcggcgcggatgcgatcatcatgcgccacccagcctcaggcgccgcgcagcagcttgcgcagttcgtcgcaccaggtggcaacggccccagcgtgatcaacgcgggtgacggttcgcaccagcaccccacccaggcgcttctcgacgctttaaccatccggcagcgcaccggccgcattgagggactcaaagttgtcatcgtgggcgactgtttgcactcccgggtggtgcgctccaatgtggatctgctgtccactttgggcgcagaggtagtgctggttgctcctccgacactgcttcctattggtgtggagaactggccagtccgattctcctacgacatggacgcagaaattgccgacgccgacgtagtgatgatgctgcgcgttcagcaagaacgcatgcagggtggtttcttcccctcacaccgtgagtacgcaacgctgtacggcatgtccaaagagcgcgaagctcgcctcaaggactccgccatcatcatgcaccccggccccatgcttcgtggcatggaaattaacttccaggtggcagacgcaccacgcaccgcggtactgcagcaggtaagcaacggtgtgcacatgcgcatggccattttgttcgccctggtcgcaggctctgacgcgactatctaatcgcgaccatctgatcgcga

SEQ ID NO: 976 - protein, 312 aa, Corynebacterium glutamicum
MKHLLSISDLSKDEIVGLLDEADRFKEVLEGREVKKLPTLRGRTIFTLFYENSTRTRSSFETAGKWMSADVINISASSSSVKKGESLKDTGLTLSAIGADAIIMRHPASGAAQQLAQFVAPGGNGPSVINAGDGSHQHPTQALLDALTIRQRTGRIEGLKVVIVGDCLHSRVVRSNVDLLSTLGAEVVLVAPPTLLPIGVENWPVRFSYDMDAEIADADVVMMLRVQQERMQGGFFPSHREYATLYGMSKEREARLKDSAIIMHPGPMLRGMEINFQVADAPRTAVLQQVSNGVHMRMAILFALVAGSDATI

SEQ ID NO: 977 - DNA, 1464 bp, Corynebacterium glutamicum
  CDS (101)..(1441): RXA00146
atggccattttgttcgccctggtcgcaggctctgacgcgactatctaatcgcgaccatctgatcgcgaaattctagaaaaggtaacgagggattaaagaagtggttgacagcaacacccagtatccagaaaccggcgcactggcaccggctcctgcagactcactcctaatcagcaacgttttggtctacggcgaaggcgagccaacgaatgtgtttgttaaagatggtgtgatcgcagctatcggcggcactcatgaggctgaccgcaccatcgacggcaatgggggagttctccttccaggtttcgtggacatgcacgttcacctgcgtgagccaggccgcgaagacactgaaaccattgccactggttctgccgccgcagccaagggcggattcaccgcagtattcaccatggcgaacaccactccagtgatggatcagccggttatcgcggaatccgtatggttcaagggccaaaacattggcctgtgcgacgtgcatccagttggatccatcaccaagggtcttgagggcaaggagcttactgagttcggcatgatggctcgctctgaagccaaggtgcgcatgttctctgatgatggcaagtgcgtcgatgatcctcaggtcatgcgccgcgcgctggaatacgccaagggcatggacgttttgatcgcccagcacgctgaggatcaccgcctgactgagggcgcttcagcacacgagggtgaaaacgcagctcgtctgggtctgcgcggctggccacgtgtggctgaggaatccatcgtggtgcgcgatgccatcatggctcgtgactacggcaaccgcgtgcacatctgccacgcctccactgaaggcaccgtggagttgcttcgttgggctaagtcccagggcattccaatcaccgcggaagtcaccccgcaccacctcaccttgaccgatgagcgcctggaaacctacgacgcggtcaacaaagtcaatccgccactgcgcgaaagccgcgatgccgaagcgctcaagaaggcgcttctcgacggcaccatcgatgttgttgcaaccgaccacgctcctcacggttccgaagataagtgctgtgaattcgaaaacgccaagccaggcatgctcggattggaaacctcactgtccatcatcgtggacaccttcgttgccaccggacttgcagactggcgctttgttgcgcgcgtgatgagtgaacgcccagcagaaatcacccgtctaccaggccagggtcgcccaatcgcagaaggtgagccagcaaacctcgcgattgttgatccaggaaaaacctggacagcatccggtgcagactttgcgtccaaggctgaaaataccccatttgagggccaagaattcagtgccaaggtcacacacaccgtgcttcgtggcaaggtgacttgtgcagacggagttgcacaaaacgcttaacgggtgggtgcatagtatgc

SEQ ID NO: 978 - protein, 447 aa, Corynebacterium glutamicum
VVDSNTQYPETGALAPAPADSLLISNVLVYGEGEPTNVFVKDGVIAAIGGTHEADRTIDGNGGVLLPGFVDMHVHLREPGREDTETIATGSAAAAKGGFTAVFTMANTTPVMDQPVIAESVWFKGQNIGLCDVHPVGSITKGLEGKELTEFGMMARSEAKVRMFSDDGKCVDDPQVMRRALEYAKGMDVLIAQHAEDHRLTEGASAHEGENAARLGLRGWPRVAEESIVVRDAIMARDYGNRVHICHASTEGTVELLRWAKSQGIPITAEVTPHHLTLTDERLETYDAVNKVNPPLRESRDAEALKKALLDGTIDVVATDHAPHGSEDKCCEFENAKPGMLGLETSLSIIVDTFVATGLADWRFVARVMSERPAEITRLPGQGRPIAEGEPANLAIVDPGKTWTASGADFASKAENTPFEGQEFSAKVTHTVLRGKVTCADGVAQNA

SEQ ID NO: 979 - DNA, 1025 bp, Corynebacterium glutamicum
  CDS (1)..(1002): RXA02208
ctcggagtcgtcgacggcgtcgcacctctaaaccgcaccatggaaaaaatcatcgcagtgcacgatgattccctctcccaggaagtcttcggcgtcaccttcccacgaccactaggcctcgccgcaggtttcgacaaaaacgcatcaatggctgatgcctggggtgccgttggattcggatacgccgaacttggcaccgtcaccgccttcccacagccaggaaaccccaccccgcgccttttccgcctgcctgccgacaaagctatcttgaaccgcatgggattcaacaacctgggtgcagcagaagtcgcaaaaaacctgcgcaaccggaaatccaccgatgtcatcggcatcaacatcggtaaaaccaaagtggttcccgctgaacacgcagtagatgactaccgccgttctgcatctttgttaggtgatcttgctgattacctggttgtcaacgtttcctcccccaacactccgggtctccgcgatctgcaggctgtggaatctttgcgaccaatcctcgccgcagtgcaggaatccaccaccgtcccagtcttggtgaaaatcgcaccagacctctccgacgaagacatcgacgccgtagctgacctggcagttgagctcaaactcgccggaatcgtagccaccaataccaccatttcccgcgaaggcctcaacactccttcaggtgaagtcgaagccatgggtgctggcggaatctccggtgctccagtagcagcccgatctttggaggtactcaagcgcctctacgcacgggtaggcaaagagatggtgttgatctctgtcggtggcatcagcacccctgagcaagcctgggaacgcatcacctccggcgcaacccttctgcagggatacaccccattcatctacggtggccccgattggatcagagatatccaccttggtatcgccaagcagctgaaagctcacggtctgcgcaacatcgctgacgctgtgggcagcgaattggagtggaagaactaaacagaccaaacacacgtgcc

SEQ ID NO: 980 - protein, 334 aa, Corynebacterium glutamicum
LGVVDGVAPLNRTMEKIIAVHDDSLSQEVFGVTFPRPLGLAAGFDKNASMADAWGAVGFGYAELGTVTAFPQPGNPTPRLFRLPADKAILNRMGFNNLGAAEVAKNLRNRKSTDVIGINIGKTKVVPAEHAVDDYRRSASLLGDLADYLVVNVSSPNTPGLRDLQAVESLRPILAAVQESTTVPVLVKIAPDLSDEDIDAVADLAVELKLAGIVATNTTISREGLNTPSGEVEAMGAGGISGAPVAARSLEVLKRLYARVGKEMVLISVGGISTPEQAWERITSGATLLQGYTPFIYGGPDWIRDIHLGIAKQLKAHGLRNIADAVGSELEWKN

SEQ ID NO: 981 - DNA, 675 bp, Corynebacterium glutamicum
  CDS (101)..(652): RXA01660
gaaaactggtgtttttcggccgtgtccaccccaggttctatgctgtaacaaacgcgggtttaaacctcaatcatcaaattagggaagggctgggaaatccatgtcatctaattccattaacgcagaagcgcgcgctgagcttgctgaactgatcaaagagctagctgtcgtccacggtgaagtcaccttgtcttcgggcaagaaggctgattactacatcgatgtccgtcgtgccaccttgcacgcgcgcgcatctcgcctgatcggtcagctgctgcgcgaagccaccgctgactgggactatgacgcagttggcggcctgaccttgggcgctgacccggttgccaccgccatcatgcacgccgacggccgcgatatcaacgcgtttgtggtgcgcaaggaggccaagaagcacggcatgcagcgtcgcattgagggccctgacctgacgggcaagaaggtgctcgtggtggaagataccaccaccaccggaaattcccctctgacagctgttgccgcgttgcgtgaagctggcattgaggttgtgggcgttgccaccgtggtcgatcgcgcaaccggtgcagatgaggttatcgcagcggaaggccttccttaccgcagcttgctgggactttctgatcttggactcaactaacacccccggccccacggagt

SEQ ID NO: 982 - protein, 184 aa, Corynebacterium glutamicum
MSSNSINAEARAELAELIKELAVVHGEVTLSSGKKADYYIDVRRATLHARASRLIGQLLREATADWDYDAVGGLTLGADPVATAIMHADGRDINAFVVRKEAKKHGMQRRIEGPDLTGKKVLVVEDTTTTGNSPLTAVAALREAGIEVVGVATVVDRATGADEVIAAEGLPYRSLLGLSDLGLN

SEQ ID NO: 983 - DNA, 957 bp, Corynebacterium glutamicum
  CDS (101)..(934): RXA02235
gtgtcaccgcagctgtccagggcatagaggccctgcgtgagggcgttgtcagcgtccgcgcgctgcaggaactcgaccacgcagtcaaggcttaagccctatgacattcggcgagaagcttctgaacgccgcctccacccgtggcaggctatgcgtgggcattgatccccacgaaagcctgctgacgtcctgggggctgccggtaaacgtagacggacttgcggagttctcccgcgcctgcgtggaggctttcgccgacaccgtggcattggtgaagcctcaggtggcgttctatgagcgtttcggttccgctggctttgccatcttggaagaaaccattcagacgctgcgtgagcgtggctgtttggtggtctctgacgccaaacgcggcgatattggctccaccatggctggctatgcctcagcgtggttagatccagcgtcaccgctgtctagcgacgctgtgacggtctctccctaccttggttttcattccttggacccagtgttcgaacttgccgagcaacacggcaggggagtgtttgtcttggccgcgacctcaaaccctgaggcccgcgaactccaggaccagcaaaacgctgacggcgtgagcatttcccagcagatcgtggatcaggcagcggcgcttaacgcgccttatatggcccagggcaaggctggcaacattggcgtcgtcatcggcgccaccttgtccaaaccaccacgcttatcgacgctcgggggcgccattttgatgcccggcgtcggcgcccagggcggcacggcaagcgacgttgatgagattgcgggagacatggctcatcttgcattcccaaatgtctctagaagtattttggcgacaggcccagatatcgctgaaatgaagaattctgtggcaaaaaatgctgcagactttcctggtttccccaggtcatagtcgcggaaacggcccttaat

SEQ ID NO: 984 - protein, 278 aa, Corynebacterium glutamicum
MTFGEKLLNAASTRGRLCVGIDPHESLLTSWGLPVNVDGLAEFSRACVEAFADTVALVKPQVAFYERFGSAGFAILEETIQTLRERGCLVVSDAKRGDIGSTMAGYASAWLDPASPLSSDAVTVSPYLGFHSLDPVFELAEQHGRGVFVLAATSNPEARELQDQQNADGVSISQQIVDQAAALNAPYMAQGKAGNIGVVIGATLSKPPRLSTLGGAILMPGVGAQGGTASDVDEIAGDMAHLAFPNVSRSILATGPDIAEMKNSVAKNAADFPGFPRS

SEQ ID NO: 985 - DNA, 852 bp, Corynebacterium glutamicum
  CDS (101)..(829): RXN01892
ggtctcagtggcttcttggttgctgtgattttttcaaggcgtaccccgtggccgatgttaaaagcggttggcacaacccctactgaaggagaacaccactgtgaccacctcgagtgaacaaccccgtacaggatacaagcgagtgatgttaaagctcggaggtgaaatgtttggtggtggcaaagtcggcgtcgatcctgatgtagtagacaatgttgcacgtcagatcgctgaagttgctaaaactggagcagagattgccgttgttatcggtggcggaaacttcttccgcggagctgagcttcagcagcgtggcatggaccgcgcacggtccgattacatgggtatgctcggcacagtcatgaactgcctcgccttgcaggacttcctcggtcagcatggcgttgaatgccgtgtccagaccgccatcaacatggcacaggtcgcagaaccatatctgccactgcgcgcagaacgccacctggaaaagggccgcgttgtcatcttcggtgctggcatgggtatgccgtacttttccacggacaccactgctgcacagcgtgcgttggaaatcggctgtgacgtcctactgatggctaaggctgttgacggtgtgtacagcgatgatcctcgtaccaacccagatgctgagctcttcaccgaaattactccaaaggaagtaattgagaagggcctgaaggttgccgatgcaactgcattcagcctctgcatggacaacaagatgcctatcttggtgtttaacctgcttactgaaggcaacattgctcgcgccatcagcggtgaacgtatcggtactctggtcgagtcctgatacatttagtcttataaaca

SEQ ID NO: 986 - protein, 243 aa, Corynebacterium glutamicum
VTTSSEQPRTGYKRVMLKLGGEMFGGGKVGVDPDVVDNVARQIAEVAKTGAEIAVVIGGGNFFRGAELQQRGMDRARSDYMGMLGTVMNCLALQDFLGQHGVECRVQTAINMAQVAEPYLPLRAERHLEKGRVVIFGAGMGMPYFSTDTTAAQRALEIGCDVLLMAKAVDGVYSDDPRTNPDAELFTEITPKEVIEKGLKVADATAFSLCMDNKMPILVFNLLTEGNIARAISGERIGTLVES

SEQ ID NO: 987 - DNA, 798 bp, Corynebacterium glutamicum
  CDS (47)..(775): FRXA01892
atgttaaaagcggttggcacaacccctactgaaggagaacaccacggtgaccacctcgagtgaacaaccccgtacaggatacaaacgagtgatgttaaagctcgaaggtgaaatgtttggtggtggcaaagtcggcgtcgatcctgatgtagtagacaatgttgcacgtcagatcgctgaagttgctaaaactggagcagagattgccgttgttatcggtggcggaaacttcttccgcggagctgagcttcagcagcgtggcatggaccgcgcacggtccgattacatgggtatgctcggcacagtcatgaactgcctcgccttgcaggacttcctcggtcagcatggcgttgaatgccgtgtccagaccgccatcaacatggcacaggtcgcagaaccatatctgccactgcgcgcagaacgccacctggaaaagggccgcgttgtcatcttcggtgctggcatgggtatgccgtacttttccacggacaccactgctgcacagcgtgcgttggaaatcggctgtgacgtcctactgatggctaaggctgttgacggtgtgtacagcgatgatcctcgtaccaacccagatgctgagctcttcaccgaaattactccaaaggaagtaattgagaagggcctgaaggttgccgatgcaactgcattcagcctctgcatggacaacaagatgcctatcttggtgtttaacctgcttactgaaggcaacattgctcgcgccatcagcggtgaacgtatcggtactctggtcgagtcctgatacatttagtcttataaaca

SEQ ID NO: 988 - protein, 243 aa, Corynebacterium glutamicum
VTTSSEQPRTGYKRVMLKLEGEMFGGGKVGVDPDVVDNVARQIAEVAKTGAEIAVVIGGGNFFRGAELQQRGMDRARSDYMGMLGTVMNCLALQDFLGQHGVECRVQTAINMAQVAEPYLPLRAERHLEKGRVVIFGAGMGMPYFSTDTTAAQRALEIGCDVLLMAKAVDGVYSDDPRTNPDAELFTEITPKEVIEKGLKVADATAFSLCMDNKMPILVFNLLTEGNIARAISGERIGTLVES

SEQ ID NO: 989 - DNA, 798 bp, Corynebacterium glutamicum
  CDS (101)..(775): RXA00105
catcttgatctgtcgccctgaacttgcagatgaacttctcgagatgtgcgcgaagttctacgaggagaatggaacttactaacgctgttatgatgacggcatgactgttccaacgccttatgaagaccttcttcggaagattgctgaagaagggtcccacaaggacgaccgcaccggcaccggcactacttctttattcggacaacaaatccgctttgatctcaatgaaggttttccccttctgaccaccaagaaggtccatttccactctgttgtgggtgagcttttgtggttccttcagggggattccaacgtcaaatggctgcaggataacaacatccgcatttggaatgaatgggcagatgaggacggcgagctgggccctgtttatggtgtccagtggcgttcttggccaacccctgatggtcgtcacattgaccagatctcaggtgctttagaaactctgcgaaacaaccctgattcacgtcgcaatattgtctcggcgtggaatgtttccgagcttgaaaacatggctcttcccccttgtcacttgcttttccagctctatgtcgccgatggcaaactgtcttgccagctctaccagcgttctgcggacatgttcctgggtgtgcctttcaacatcgcatcttatgcactgctcacccacatgtttgcccagcaggcaggcttggaagtcggcgagttcatttggactggcggcgactgccacatttatgacaaccacaaggaacaggtcgcggagcagctgagccgataagctcgcccctaccccacctt

SEQ ID NO: 990 - protein, 225 aa, Corynebacterium glutamicum
MTVPTPYEDLLRKIAEEGSHKDDRTGTGTTSLFGQQIRFDLNEGFPLLTTKKVHFHSVVGELLWFLQGDSNVKWLQDNNIRIWNEWADEDGELGPVYGVQWRSWPTPDGRHIDQISGALETLRNNPDSRRNIVSAWNVSELENMALPPCHLLFQLYVADGKLSCQLYQRSADMFLGVPFNIASYALLTHMFAQQAGLEVGEFIWTGGDCHIYDNHKEQVAEQLSR

SEQ ID NO: 991 - DNA, 732 bp, Corynebacterium glutamicum
  CDS (101)..(709): RXA00131
aggctctcggcggtcagctcaccgaactgaccaaggagcaggctgagtacatcggcgttgacgttgcaggcccattcaagccggagcactaccgctactaatgattgtcagcattgagggaatcgacggcgccggcaaaaacaccctggtttcggcattaacgcaggttattgatgcaaaagtccttgcattcccacgttatgaaacctcgattcacgcccaattggccgcggaagcactccacggccgcatgggcgacctcaccgacagcgcctacgccatggccacgcttttcgccctcgaccgccacttcgcgattgatgacttaaatgcgcccggcgtggtgctgctcgaccgatacgtcgcctccaacgcggcttataccgccgccagattgcttgacgacgacgccccccgctgggttgccgacctggaattcgggcggcttgggctcccacgtccgacgcttcaagtgttgttggatacccccgcggaggtagcgcaagatagggctagacgtcgagaagcgcttgactccgcgcgtgcgcgggaccgctatgaatcggattcggcgctgcagcaacgcaccgccgagcactatcgccgcctcgcggcggacaactgggaatcaccgtggatcgtggttgcccctgatgaagaccccggccacgttgcgcagagaatcgtggaattcctgggtactataaactaatcccaattagcaggaaggat

SEQ ID NO: 992 - protein, 203 aa, Corynebacterium glutamicum
MIVSIEGIDGAGKNTLVSALTQVIDAKVLAFPRYETSIHAQLAAEALHGRMGDLTDSAYAMATLFALDRHFAIDDLNAPGVVLLDRYVASNAAYTAARLLDDDAPRWVADLEFGRLGLPRPTLQVLLDTPAEVAQDRARRREALDSARARDRYESDSALQQRTAEHYRRLAADNWESPWIVVAPDEDPGHVAQRIVEFLGTIN

SEQ ID NO: 993 - DNA, 531 bp, Corynebacterium glutamicum; identical to SEQ ID NO: 965
  CDS (101)..(508): RXA00266

SEQ ID NO: 994 - protein, 136 aa, Corynebacterium glutamicum; identical to SEQ ID NO: 966

SEQ ID NO: 995 - DNA, 831 bp, Corynebacterium glutamicum
  CDS (101)..(808): RXA00718
gcaccaagctgcacaccgttcagcttggtgatcagaagccaggttcccttcgtgcactgaactcctctgagctgaccagcttatacaaggtggtccaactgtgacggaaatttccaacatgcctgccggtggcctcatcgtagccatcgacgggccgtctggcaccggaaaatccaccacatcccgcgcgctcgcaacccgtctctcggccaagtacctagatactggtgcgatgtaccgcgtcgcaacgcttcatgtgcttaaccaggggattgaccctgcagatagcgcagccgtgatcgctgcaaccgctgtattgccgttgtcgatttctgacgatcccgcctccactgaggtgttgctcgcgggcgtcgatgtgcaaaaggacatccgcggaccagaagtcacccaaaatgtctccgcagtgtccgcgatccctgaggttcgtgaaaacttggtggcgttgcagcgcgcactcgccgccaaagcacatcgctgcgtcgtcgaaggcagagacatcggaacggcagtgcttgtcgacgcgcccatcaaggcgtttctcaccgcctcagcggaagtccgcgcccagcgacgctttgaccaagacaccgcagcaggtcgcgacgtagatttcgacgctgtgctggcagatgttgttcgccgcgatgaactagattccacccgtgccgcctcaccgctgaaaccagcagatgatgcacacatcgtggacacctctgatatgaccatggatcaagtacttgatcacctcatccacctagtggaagcctccgctgaaaggagcaaccagtgactgataaacacaccatgcct

SEQ ID NO: 996 - protein, 236 aa, Corynebacterium glutamicum
VTEISNMPAGGLIVAIDGPSGTGKSTTSRALATRLSAKYLDTGAMYRVATLHVLNQGIDPADSAAVIAATAVLPLSISDDPASTEVLLAGVDVQKDIRGPEVTQNVSAVSAIPEVRENLVALQRALAAKAHRCVVEGRDIGTAVLVDAPIKAFLTASAEVRAQRRFDQDTAAGRDVDFDAVLADVVRRDELDSTRAASPLKPADDAHIVDTSDMTMDQVLDHLIHLVEASAERSNQ

SEQ ID NO: 997 - DNA, 1785 bp, Corynebacterium glutamicum
  CDS (101)..(1762): RXA01599
caccgaacgtttaagttttccgcaccgcctgactcgaaaagatcttttttaaagagctgttcgatgtttaggttcaaccaggaaggtcgtctcagacatcatgacctctagtcgaaaagtccgtcccaccaaacacattttcgtcaccggtggagttgtttcctcactcggcaaaggcctgaccgcagcaagccttggtcaattgctgattgcacggggactgtcggtgaccatgcagaagctggatccatacctcaatgttgatccgggcaccatgaatccttttgaacacggtgaagtctttgtcaccgaagacggggcagaaacagacctggatttgggccactacgagcgtttcctcgatcgcaacctggggctcaacgccaatgtcaccaccggcaaggtgtattccactgtgatcgccaaggagcgcaggggagagtacctgggtaaaactgtgcaggtcatcccacacatcactgatgagatcaaagctcgtattttgagcatgggcgaaccagatgctcatggtaacgccccagacgtggtgatctctgaggtcggtggcaccgtcggtgacattgaatcccagccattccttgaagcagctcgccaggtacgccatgaaattggtcgtgaaaactgcttcttcatccactgttctttggtgccatacttggctacctcaggtgagctgaagaccaaacccacccagcattctgtcgcagagctgcgcggcatcggtattttgccggatgctctcgtgcttcgttgcgatcgggaggtccctcaaggtctgaaagataagatcgcgatgatgtgcgatgttgattatgaaggcgttgtatcttgccctgattccagttctatttacaacattccagatgtcctctaccgcgagcacctggacaccttcattattcgtcgcctgggccttccgttccgtgatgttgactggagcacctggcacgatctgctggaacgggtgaacaacccacgccatgagctcaccgtcggcatcgtgggcaagtacattgatcttcccgatgcttatctctcagtggtggaagctgttcgcgctgcaggctacgccaattggacgcgcaccaatatcaagtggattacctcagatgattgcgaaaccccatctggcgccatgaaagcgctcagcggtttggatgccatcgtggttcccggaggtttcggtatccgaggtatcgaaggcaaaatcggtgcgattacgtttgcacgtgagcacaagatcccgcttcttggcctatgccttggcctgcagtgcaccgtcatcgaggcagcacgccaggcaggactggagcaggcatcatccactgagtttgacccagctgcaacgcagccagtgatcgccaccatggaagagcagaaagctgctgtgtcgggtgaagctgatctgggtggcaccatgcgtcttggcgcatatcctgcaaccctggaggaaggctccttagtagcggaactgtatggcacaacggaagtctccgagcgccaccgtcaccgctatgaggtcaataatgcctaccgcgcccagattgctgaaggttcagatttggtcttctccggaacctcacctgatggacatttggtggagttcgtggagtaccccaaagaggtgcatccttatctggtggcaacccaggcgcaccctgagtacaaatctcgtccaacccatgctcatccactgttttacggcctggtgaagaccgctttggagctgcgtgtccacccttagatctacaatgtgatcatggt

SEQ ID NO: 998 - protein, 554 aa, Corynebacterium glutamicum
MTSSRKVRPTKHIFVTGGVVSSLGKGLTAASLGQLLIARGLSVTMQKLDPYLNVDPGTMNPFEHGEVFVTEDGAETDLDLGHYERFLDRNLGLNANVTTGKVYSTVIAKERRGEYLGKTVQVIPHITDEIKARILSMGEPDAHGNAPDVVISEVGGTVGDIESQPFLEAARQVRHEIGRENCFFIHCSLVPYLATSGELKTKPTQHSVAELRGIGILPDALVLRCDREVPQGLKDKIAMMCDVDYEGVVSCPDSSSIYNIPDVLYREHLDTFIIRRLGLPFRDVDWSTWHDLLERVNNPRHELTVGIVGKYIDLPDAYLSVVEAVRAAGYANWTRTNIKWITSDDCETPSGAMKALSGLDAIVVPGGFGIRGIEGKIGAITFAREHKIPLLGLCLGLQCTVIEAARQAGLEQASSTEFDPAATQPVIATMEEQKAAVSGEADLGGTMRLGAYPATLEEGSLVAELYGTTEVSERHRHRYEVNNAYRAQIAEGSDLVFSGTSPDGHLVEFVEYPKEVHPYLVATQAHPEYKSRPTHAHPLFYGLVKTALELRVHP

SEQ ID NO: 999 - DNA, 3462 bp, Corynebacterium glutamicum; identical to SEQ ID NO: 367
  CDS (101)..(3439): RXN02234

SEQ ID NO: 1000 - protein, 1113 aa, Corynebacterium glutamicum; identical to SEQ ID NO: 368

SEQ ID NO: 1001 - DNA, 3221 bp, Corynebacterium glutamicum; identical to SEQ ID NO: 369
  CDS (1)..(3198): FRXA02234

SEQ ID NO: 1002 - protein, 1066 aa, Corynebacterium glutamicum; identical to SEQ ID NO: 370

SEQ ID NO: 1003 - DNA, 424 bp, Corynebacterium glutamicum
  CDS (101)..(424): RXN00450
tttgcgatgacatggatttggatccttccgaacaattgctgcgcatcgcggaagaactcggttttgataatgatctggctcgggtggtgggattcgactagtgggcgttttacctgtgcaggcgcgcatcaaagacgatgagcgccgcatgcgccatgctttggatattgctcgccaaacccctgagggggacgttcccgttggcgccgtcatttacgcgccgaccggggagatcctggcgaccgcaacgaaccgtcgagaagcagaccgcgatcccacggcccacgccgaaattattgctttacgacgagccgcccgccgtttttccgacggctggcggctgagtgactgcaccgcggtggtcaccttggagccctgcagtatgtgcgccggcgccttggtgggtgctcgaatcggacgcatc

SEQ ID NO: 1004 - protein, 108 aa, Corynebacterium glutamicum
VGVLPVQARIKDDERRMRHALDIARQTPEGDVPVGAVIYAPTGEILATATNRREADRDPTAHAEIIALRRAARRFSDGWRLSDCTAVVTLEPCSMCAGALVGARIGRI

SEQ ID NO: 1005 - DNA, 418 bp, Corynebacterium glutamicum
  CDS (101)..(418): FRXA00450
tttgcgatgacatggatttggatccttccgaacaattgctgcgcatcgcggaagaactcggttttgataatgatctggctcgggtggtgggattcgactagtgggcgttttacctgtgcaggcgcgcatcaaagacgatgagcgccgcatgcgccatgctttggatattgctcgccaaacccctgagggggacgttcccgttggcgccgtcatttacgcgccgaccggggagatcctggcgaccgcaacgaaccgtcgagaagcagaccgcgatcccacggcccacgccgaaattattgctttacgacgagccgcccgccgtttttccgacggctggcggctgagtgactgcaccgcggtggtcaccttggagccctgcagtatgtgcgccggcgccttggtgggtgctcgaatcgga

SEQ ID NO: 1006 - protein, 106 aa, Corynebacterium glutamicum
VGVLPVQARIKDDERRMRHALDIARQTPEGDVPVGAVIYAPTGEILATATNRREADRDPTAHAEIIALRRAARRFSDGWRLSDCTAVVTLEPCSMCAGALVGARIG

SEQ ID NO: 1007 - DNA, 1368 bp, Corynebacterium glutamicum
  CDS (101)..(1345): RXN02272
tatttaactccacactaatacctgtcaagcaatagaatagatagcatctggatcctccagagtttgaaaatatgccttgacatgtagaaatggagttcttgtgcgcattacaaacgcccaggttaagaactacgcagagttagttgatatcaccatagagggtgaaaaaatttcctcgattaccccctcttcaattcgatcagaagaagatcaccgcgcggacgattacgatgccgcaggaagactggtcgcaccccagttcgccgaagcacacatccaccttgactacgcaaacaccgctggaatccctcgcgaaaactcttccggcacactttttgaagccatcgaaatctgggccgaccgcaagacccaaggcttccacatcaaagaagacattaaagcgaaggccctccaggcagcccgtcgggcagcagaacacggcgttggtttcatccgcactcacgtagatgtcaccgatcccacgtttgctggattcgaagcaattgcggagctgcgcgatgaagtccgcgagtggtgcgatatccagattgtcgccttcccgcaaaatggcatttacgcctacgaaggtggccagaagctaatctcagatgcaatgtctgcaggtgcagatgtcgttggtggcatcccacaccttgaacccacccgagacgatggcgtcgagtcggtgaaatggctgttcgaccttgcagagaagcactcagcccccatcgatatccacactgatgaaattgacgatccacattcccgatttgtcgaagtcctcgccgcagaagccgcaaaacgtgacatgggcgcacaaaccgtggtgtctcattctgtggcgatggcctattactcacctggctacatggcgcgacttttacccaagctcgcagcatcaaaggttcgttttgcagtatgccccaatgaaaacctccatctgcaaggacttggtttccaaggacccgtcccccgaggtgttgcaccggtaaagcaacttaccgaatggggaattccagtaagtttttgccaggactcactcaatgaccccttctaccccatgggcgatggagatctactccgcattctcgattctggattacacgtgtcccacatgctcacagccagccacttgaagaatgcactatcgttcatcaccaccaatccagccggaaacctaggcctggacaattacgacattgcagaaaactccccggcgaacctgctggttcttgatgcgagcagcgagaaggaagctgtacagagaaaagcttccgtacttttgagcatccaccgcggcaaaaaggtgctctccagggagcccgaacaggtggactggaacatctaacagcccagttgggcctcctt

SEQ ID NO: 1008 - protein, 415 aa, Corynebacterium glutamicum
VRITNAQVKNYAELVDITIEGEKISSITPSSIRSEEDHRADDYDAAGRLVAPQFAEAHIHLDYANTAGIPRENSSGTLFEAIEIWADRKTQGFHIKEDIKAKALQAARRAAEHGVGFIRTHVDVTDPTFAGFEAIAELRDEVREWCDIQIVAFPQNGIYAYEGGQKLISDAMSAGADVVGGIPHLEPTRDDGVESVKWLFDLAEKHSAPIDIHTDEIDDPHSRFVEVLAAEAAKRDMGAQTVVSHSVAMAYYSPGYMARLLPKLAASKVRFAVCPNENLHLQGLGFQGPVPRGVAPVKQLTEWGIPVSFCQDSLNDPFYPMGDGDLLRILDSGLHVSHMLTASHLKNALSFITTNPAGNLGLDNYDIAENSPANLLVLDASSEKEAVQRKASVLLSIHRGKKVLSREPEQVDWNI

SEQ ID NO: 1009 - DNA, 1368 bp, Corynebacterium glutamicum; identical to SEQ ID NO: 1007
  CDS (101)..(1345): FRXA02272

SEQ ID NO: 1010 - protein, 415 aa, Corynebacterium glutamicum; identical to SEQ ID NO: 1008

SEQ ID NO: 1011 - DNA, 580 bp, Corynebacterium glutamicum
  CDS (101)..(580): RXN03004
gctagcacgataaaaatcagcgccagcaccacgcgccccaggaacctcatcgcagcaacccgtggcccaaccctgaacgctgaacgctacactggttgacgtgcttctttcagatcgtgacattcgtaaatcaattgacgcaggcgacttgggaattgaacctttcgacgctgagctgattcagccgtcgagtgtcgatgtccgcatggaccgctacttccgggttttcaataactctaagtacacccacattgaccctaagttgaatcaggatgagctgaccagccttgttgaggttgaggacggcgagggctttgtgctgcatccgggtgagtttgtgctggcgtccacgctggaaaagttcactttgcctgcgcatctggctggtcgtttggagggtaagtcgtctcttggtcgtcttggcttgttgacgcactctactgctggtttcattgatcctggttttagtggttacatcacgttggagttgtccaatgtggctaatctgccgatcacgttgtggccgggtatgaaggtggggcagctggctttgttccagatgagttcccctgcggagact

SEQ ID NO: 1012 - protein, 160 aa, Corynebacterium glutamicum
VLLSDRDIRKSIDAGDLGIEPFDAELIQPSSVDVRMDRYFRVFNNSKYTHIDPKLNQDELTSLVEVEDGEGFVLHPGEFVLASTLEKFTLPAHLAGRLEGKSSLGRLGLLTHSTAGFIDPGFSGYITLELSNVANLPITLWPGMKVGQLALFQMSSPAET

SEQ ID NO: 1013 - DNA, 225 bp, Corynebacterium glutamicum
  CDS (101)..(202): RXN03137
cggcgagttcatttggactggcggcgactgccacatttatgacaaccacaaggaacaggtcgcggagcagctgagccgataagctcgcccctaccccaccttggagctcaacaaggcagcgtacatgtttgagtacagcttcgatgacatcaccgtgtccggctacgatccacacccattgatccgcggcaaggtcgccgtatgatcggtgcgatttgggcacaa

SEQ ID NO: 1014 - protein, 34 aa, Corynebacterium glutamicum
LELNKAAYMFEYSFDDITVSGYDPHPLIRGKVAV

SEQ ID NO: 1015 - DNA, 613 bp, Corynebacterium glutamicum
  CDS (101)..(613): RXN03171
atactttgttggactggaaaagtggccgtttggttccctccaagcccaaattcgcccgcgcggtcttcttctgggcggcaatgatttaacatgtgaagctatggacatcaccatcgtcaaccacccactcgttgctagccgcctaaccctgttgcgcgacgagcgcagcgacaacgcagctttccgtgcagcagccaacgacctcggcgccatgctgatctacgaagcatcccgagatctggaagtcgaacacttcgacaccaaaacccccgttgccatggctgaaggtactcgcctgaagcagccacccatcatcgttcccatcatccgtgcaggtctcggcatgatcgacccagcgctgtcgatgattccggatgcacaggtcggcttcattggccttgcccgcgatgaggaaacccatgagccagtcccataccttgaggcgctgccacaggatctaagcaaccagcctgtattccttgtcgatcccatgctggccaccggcggttccctcctgcacgcgatccgccttcttgctgatcgtggcgccaccgacatcaccgccatctgcatggtttctgcgcagccaggtgtggacgcattggcggaatct

SEQ ID NO: 1016 - protein, 171 aa, Corynebacterium glutamicum
MDITIVNHPLVASRLTLLRDERSDNAAFRAAANDLGAMLIYEASRDLEVEHFDTKTPVAMAEGTRLKQPPIIVPIIRAGLGMIDPALSMIPDAQVGFIGLARDEETHEPVPYLEALPQDLSNQPVFLVDPMLATGGSLLHAIRLLADRGATDITAICMVSAQPGVDALAES

SEQ ID NO: 1017 - DNA, 613 bp, Corynebacterium glutamicum; identical to SEQ ID NO: 1015
  CDS (101)..(613): FRXA02857

SEQ ID NO: 1018 - protein, 171 aa, Corynebacterium glutamicum; identical to SEQ ID NO: 1016

SEQ ID NO: 1019 - DNA, 678 bp, Corynebacterium glutamicum
  CDS (101)..(655): RXA02771
gtttgtgatagatcgcacagtcggtaacgttgttgttaatacagacctagccggtatcggatggaacatggaccgttggtccagaagtgaggaataagtagtgagcgaacaagctctaagcaccttcgacagggcacgtgaggccctggacaagaaaacccgatatgtgcaggatttcccagaaaaaggtgtgctttttgaagacctcaccccggtgttgggcgatgcagaatcatttgtggccgtggtggacgccatggctgaagctgcagaaaaactgaatgcagaaatcatcggtggcttggatgcgcgaggattcctcctcggatctgctgtcgcttacaaactcggcctaggtgtgctggctatccgcaagaagggaaagctccccccacctgtggtgacccaggagtatgaacttgaatacggcactgcagcactcgagctgcccagtgaaggaatcgacattgctggtaaaaacatcgttttgatcgacgatgtgctggcaaccggcggcaccttgggcgctgcacgtaaactaattgaatcgtgtgacggacatgtttccggatatgttcttgccattgaggtcccaggcctcggcggtagggataatcttggtgataggcccgtcattgtggtcagagatcctcagtagaaggatcgaaagaaaggcgg

SEQ ID NO: 1020 - protein, 185 aa, Corynebacterium glutamicum
VSEQALSTFDRAREALDKKTRYVQDFPEKGVLFEDLTPVLGDAESFVAVVDAMAEAAEKLNAEIIGGLDARGFLLGSAVAYKLGLGVLAIRKKGKLPPPVVTQEYELEYGTAALELPSEGIDIAGKNIVLIDDVLATGGTLGAARKLIESCDGHVSGYVLAIEVPGLGGRDNLGDRPVIVVRDPQ

SEQ ID NO: 1021 - DNA, 723 bp, Corynebacterium glutamicum
  CDS (101)..(700): RXA01512
gggtaaaagcgataatggaaggttggaagtggtgcggcaaagtggcaagcttaagatcactgattgacacctgaatctacaacacaaggggaacgcgacgatgagcaacaacgtagaaatggccgaccacaaagatctcaatgttccagccaacccatacggcaccgacattgaatcagtattgatcagcgaagagaagctcaagcagcgcatcgccgaaatggccaagcgcgtctccgaagagttcaaagacgccgaagaagacctcatcctggtgtgcgtgctcaagggcgcgttctacttcctggcagatttctcccgcatgctcgacatccccacccagtccgagttcatggcggtgtcctcttacggaaactccacctcctcttcaggcgtggtgcgcatcctcaaggacctggacaaggaaattgaaggccgcgacgttttgatcgtggaagacatcatcgattccggactgaccctgtcctggctgatgcgcaacctgaaaaaccgcaaccctaagtccctcaacgtgatcaccttgctgcgtaagccagagcgcctgaccaccaacatcgacatgttcgacattggatttgatattccaaatgagtttgttgtgggctacggacttgatttcgcagaacgctaccgcgacctgccatatgtgggcaccctcgagcctcacgtgtactccgactagtaatcaaaagtgcgaaagag

SEQ ID NO: 1022 - protein, 200 aa, Corynebacterium glutamicum
MSNNVEMADHKDLNVPANPYGTDIESVLISEEKLKQRIAEMAKRVSEEFKDAEEDLILVCVLKGAFYFLADFSRMLDIPTQSEFMAVSSYGNSTSSSGVVRILKDLDKEIEGRDVLIVEDIIDSGLTLSWLMRNLKNRNPKSLNVITLLRKPERLTTNIDMFDIGFDIPNEFVVGYGLDFAERYRDLPYVGTLEPHVYSD

SEQ ID NO: 1023 - DNA, 597 bp, Corynebacterium glutamicum
  CDS (101)..(574): RXA02031
tgcttgggcgttaacgattctatatatacttccctagaaatcaagtgagcattcatctcattgcagaacgttgaagcatcattgactaggatatgtagacatgacagaggaacgcgagattctgacctatgagatgttcggaacagcaatgcgggagctggcccaagaaattattgatgactaccagccagattgcgtgctgtccattgcgcgtggtggtcttctaatcggtggcgcacttggttatgcgctgggtatcaagaatgtatcggtgatcaatgtggagttctacaccgatattggagagcacttggaggagccaatgatgctgcctccaactccaaaagctgttgatctctcgggaatgcgtgtgctcgtcgctgacgatgtcgcggataccggaaagactcttgagttggtcagggacttcctgggtgaccaagttgtcgaagtgcgcactgcagtgatctatcacaagccaaacagtgtgtttaagccggagtatgtgtggcgtgagactgataagtggattaacttcccatggtctaccctgcctccagtggagccttctaagtaatttttcacccgtgaaagtgc

SEQ ID NO: 1024 - protein, 158 aa, Corynebacterium glutamicum
MTEEREILTYEMFGTAMRELAQEIIDDYQPDCVLSIARGGLLIGGALGYALGIKNVSVINVEFYTDIGEHLEEPMMLPPTPKAVDLSGMRVLVADDVADTGKTLELVRDFLGDQVVEVRTAVIYHKPNSVFKPEYVWRETDKWINFPWSTLPPVEPSK

SEQ ID NO: 1025 - DNA, 753 bp, Corynebacterium glutamicum
  CDS (101)..(730): RXA00981
aaccaatggctgggtactgatgtggtgatcagtgcccagtttcttctttctactagtgtcggatagaagtacccccagtccagaatgaaggtcaccaccaatgtcagagaatttgccagcgcccgagaatctcctggacgccgagagaattcagatgatcaagaacttccgcaacgaattaacggggttcatgctcaactaccaatttggcattgatgagatcctgaccaagatcaacatcctgaaaactgaattcagccagctgcacgaatacgcacctatcgagcacgtatcttcacgattgaagacaccagaaagcatcgtcaaaaaggtcatccgaaaaggagacgagctctccctcgcagctatcaaagacacagtgtttgatatcgcaggcattcgaatcgtctgcagtttcctcaaagatgcctacgcaatcgccgatatgctgaccaaccaaaaagacgtcacggtcatcgaggccaaagactacatcgctaacccaaagccgaacggctacaagagtttgcaccttatcctccaagtgcctgtcttcctgtctaactccgtggaaaaggtcaatgttgaagtccagatccgcaccattgccatggacttctgggcaagcctcgagcacaaaatctactacaaatttgaacaagaagttcctcagtcaatccttgatgagctcagtgaagatggaaagaatccacggggaagtgaagtcacttaaacctccagttgaaaccactg

SEQ ID NO: 1026 - protein, 210 aa, Corynebacterium glutamicum
MSENLPAPENLLDAERIQMIKNFRNELTGFMLNYQFGIDEILTKINILKTEFSQLHEYAPIEHVSSRLKTPESIVKKVIRKGDELSLAAIKDTVFDIAGIRIVCSFLKDAYAIADMLTNQKDVTVIEAKDYIANPKPNGYKSLHLILQVPVFLSNSVEKVNVEVQIRTIAMDFWASLEHKIYYKFEQEVPQSILDELSEDGKNPRGSEVT

SEQ ID NO: 1027 - DNA, 1158 bp, Corynebacterium glutamicum
  CDS (101)..(1135): RXN02772
tgaggtcccaggcctcggcggtagggataatcttggtgataggcccgtcattgtggtcagagatcctcagtagaaggatcgaaagaaaggcggcaggaaaatgagtctggagcgcaacacacaaaaatcttccatgggtgtgcgaagcatgtcagccaggcttgcccgcagcctcacaggaaaccgcgttcgcaccaaccctgtgctggatccgctgctgagcatccaccggcaatttcacccacgcgccgacgtacaagtgttggaacgtgcatatgacaccgcggaacgtcttcatgatggtgtgattcgaaaatcgggcgatccgtatattacccacccgttggctgtcgccaccatcgccgcggaaatcggcatggacaccaccacgctcgtcgcagccttgttgcatgacacggtggaagacaccgactactctttggacgatctcacccgagatttcggagaagaagttgccaggcttgtcgacggtgtcaccaagctcgacaaagtcgcactaggtgctgccgcggaggccgaaacgattcgcaaaatgatcgtcgccatgagccaggacccccgcgtgctggtgattaaagtggccgaccgtttgcacaatatgcgcaccatgcggttcctgccgccggaaaagcaagctaaaaaagcacgccaaacccttgaagtgattgctcctttggcacaccgcctgggcatggccagcgtgaaatgggaattggaagatctatcctttgccattttgtaccccaagaagtacgaagagatcgtgcgtcttgttgccgaccgcgcgccctctagagaccggtacctcaaagaaattattgatcaagtcaccggtggcttgcgcgaaaacaacatcgcggcagaagtgcttggtcgaccaaagcactactggtctatctatcaaaagatgatcgttcgcggtcgtgattttgacgatatttttgatcttgttggcatccgcatcctggtagacaacgtgaacaactgtgtacgccgccatcggtgtcgtgcactccctgttcaatgctctgcctggccgattcaaagactatatttcagccccgcgcttcggtgtctaccaatccctgcacaccaccgtgatgggacctggcggtaagcctctggaagttcaggcac

SEQ ID NO: 1028 - protein, 345 aa, Corynebacterium glutamicum
MSLERNTQKSSMGVRSMSARLARSLTGNRVRTNPVLDPLLSIHRQFHPRADVQVLERAYDTAERLHDGVIRKSGDPYITHPLAVATIAAEIGMDTTTLVAALLHDTVEDTDYSLDDLTRDFGEEVARLVDGVTKLDKVALGAAAEAETIRKMIVAMSQDPRVLVIKVADRLHNMRTMRFLPPEKQAKKARQTLEVIAPLAHRLGMASVKWELEDLSFAILYPKKYEEIVRLVADRAPSRDRYLKEIIDQVTGGLRENNIAAEVLGRPKHYWSIYQKMIVRGRDFDDIFDLVGIRILVDNVNNCVRRHRCRALPVQCSAWPIQRLYFSPALRCLPIPAHHRDGTWR

SEQ ID NO: 1029 - DNA, 903 bp, Corynebacterium glutamicum
  CDS (101)..(880): FRXA02772
  misc_feature 850, 853: n = a, g, c, or t
cattgtggtcagagatcctcagtagaaggatcgaaagaaaggcggcaggaaaatgagtctggagcgcaacacacaaaaatcttccatgggtgtgcgaagcatgtcagccaggcttgcccgcagcctcacaggaaaccgcgttcgcaccaaccctgtgctggatccgctgctgagcatccaccggcaatttcacccacgcgccgacgtacaagtgttggaacgtgcatatgacaccgcggaacgtcttcatgatggtgtgattcgaaaatcgggcgatccgtatattacccacccgttggctgtcgccaccatcgccgcggaaatcggcatggacaccaccacgctcgtcgcagccttgttgcatgacacggtggaagacaccgactactctttggacgatctcacccgagatttcggagaagaagttgccaggcttgtcgacggtgtcaccaagctcgacaaagtcgcactaggtgctgccgcggaggccgaaacgattcgcaaaatgatcgtcgccatgagccaggacccccgcgtgctggtgattaaagtggccgaccgtttgcacaatatgcgcaccatgcggttcctgccgccggaaaagcaagctaaaaaagcacgccaaacccttgaagtgattgctcctttggcacaccgcctgggcatggccagcgtgaaatgggaattggaagatctatcctttgccattttgtaccccaagaagtacgaagagatcgtgcgtcttgttgccgaccgcgcgccctctagagaccggtacctcaaagaaattattgatcaagtcaccggtggcttgcgcgaaaacaacatcgcggcagaagtgcttggtcgnccnaagcactctggtctttctttcaaaagatgatcgttcgcggtcgtgatttt

SEQ ID NO: 1030 - protein, 260 aa, Corynebacterium glutamicum
MSARLARSLTGNRVRTNPVLDPLLSIHRQFHPRADVQVLERAYDTAERLHDGVIRKSGDPYITHPLAVATIAAEIGMDTTTLVAALLHDTVEDTDYSLDDLTRDFGEEVARLVDGVTKLDKVALGAAAEAETIRKMIVAMSQDPRVLVIKVADRLHNMRTMRFLPPEKQAKKARQTLEVIAPLAHRLGMASVKWELEDLSFAILYPKKYEEIVRLVADRAPSRDRYLKEIIDQVTGGLRENNIAAEVLGRPKHSGLSFKR

SEQ ID NO: 1031 - DNA, 262 bp, Corynebacterium glutamicum
  CDS (101)..(262): FRXA02773
  misc_feature 71, 74, 155, 162, 192, 211, 214, 225, 230, 234: n = a, g, c, or t
  VARIANT 19, 45: Xaa = Phe, Leu, Ile, or Val
  VARIANT 21: Xaa = Val, Ala, Glu, or Gly
  VARIANT 31: Xaa = Leu, Pro, His, or Arg
  VARIANT 42: Xaa = Val, Ala, Asp, or Gly
  VARIANT 44: Xaa = Ser, Pro, Thr, or Ala
tcaaagaaattattgatcaagtcaccggtggcttgcgcgaaaacaacatcgcggcagaagtgcttggtcgnccnaagcactctggtctttctttcaaaagatgatcgttcgcggtcgtgattttgacgatatttttgatcttgttggcatccgcntcctggnagacaacgtgaacaactgggtacgccgccntcggtgtcgtgcactcccngtncaatgctctgnctggncgnttcaaagactatatttcagccccgcgctt

SEQ ID NO: 1032 - protein, 54 aa, Corynebacterium glutamicum
  VARIANT 19, 45: Xaa = Phe, Leu, Ile, or Val
  VARIANT 21: Xaa = Val, Ala, Glu, or Gly
  VARIANT 31: Xaa = Leu, Pro, His, or Arg
  VARIANT 42: Xaa = Val, Ala, Asp, or Gly
  VARIANT 44: Xaa = Ser, Pro, Thr, or Ala
MIVRGRDFDDIFDLVGIRXLXDNVNNWVRRXRCRALPVQCSXWXXQRLYFSPAL

SEQ ID NO: 1033 - DNA, 654 bp, Corynebacterium glutamicum
  CDS (101)..(631): RXA01835
tcaacatctattcctcctgcgatttgcatgggatatatattaaaaattctagccgaaagtttcctgcgtgaatacactttccccgcgccttcgcaaagctatgaatactgccgcgtgggcacaccgccaccacgtacgcaaaggcggtggaattccgtatgtcagccatctttattcagtgatgtacttgctggccagcgtcactaatgatgaagatgtgctcatcgccgggctgctccacgacaccctcgaagacgtacccgaggaatacaattctgcccaacttgaagctgattttggtccgcgggtgcgcgagttggtggaagagctcaccaaacagcccttaaaaagctggaaagcgcgtgccgacgcttacctcctgcacctcagcgcaggtgccagcttagaggctgtcttaatctccaccgcagataaactgcataatctcatgtccatcttggatgaccttgaaatacacggtgaagatttatggcaacgctttaacgctggcaaagagcagcaaatctggtggtatagcgaggtttatcagatatctctccagcgcttagggttcaatgagttgaataaacaactggggttgtgcgtcgaaaagctcttaaagcaaagcgcctaggcgctcggcggcgtcgataa

SEQ ID NO: 1034 - protein, 177 aa, Corynebacterium glutamicum
MNTAAWAHRHHVRKGGGIPYVSHLYSVMYLLASVTNDEDVLIAGLLHDTLEDVPEEYNSAQLEADFGPRVRELVEELTKQPLKSWKARADAYLLHLSAGASLEAVLISTADKLHNLMSILDDLEIHGEDLWQRFNAGKEQQIWWYSEVYQISLQRLGFNELNKQLGLCVEKLLKQSA

SEQ ID NO: 1035 - DNA, 1395 bp, Corynebacterium glutamicum
  CDS (101)..(1372): RXA01483
gggtgcccgataaggtgaagcatctttgcgcgcaatccaaggtctgctgcgcccttcgcggcgtgcacgccatgagcaacttcggaggctgaaaaagtagatgtacccctattccgacgcagacgcttttcgacgccagcctgagcgcgccaagtccagccaactgcgtaccagcgccgtagacacccgcagcgcgttcgcccgcgaccgggctcgcgtgctgcattctgctgctcttcgacgcctcgcggataaaacccaagtggttggccccaatgatggtgatactccgcgcacccggctgacgcactctttggaagtagctcaaattgcacggggaatcggagctggactggatttggatcctgatctgtgcgatctggcagggctgtgccatgacattgggcatccgccgtatggacacaacggtgaaaacgcgttgaatgaagttgctgcggcctgtggaggatttgagggcaacgcccaaaccttgcgtattctcacgcgtctggagccaaaaattgtctctgatgagggggagagctttgggctgaacttgtcgcgggctgctcttgatgctgcatgtaagtatccgtgggctaaaacaaatgcggatggcagtgtcaataagaaatacagtgcttatgacgaggacgcagaaatcctcgcttggattagacaaggccatgaggatcttcgcccaccgatcgaagcgcaggtcatggacttttctgatgacattgcctactcggtgcacgatgtggaagacggtattgtatccgggcgtatcgacttaaaagtgctgtgggacctggttgaattagcagctttggcagacaaaggagcagctgctttcggaggttcgcctgcagagctcatcgagggtgcagcatcgttgcgggaacttccggtggtggctgccgctgcggattttgatttctcactgcgttcctacgctgcgctgaaggcgatgacttcagaactagtgggaagatacgttggctctaccatcgagtcaacaaagaaaacacacgctggcattgatgtgggacgcatgcacggcgatttgatcattccagaaacagcggccagtgaagtaaaactgctcaaaacgttagcggttctctacgtgatggatgacccagggcaccttgcgcgccaaaacaggcaacgggatcgtatcttccgggtttttgactacctggtgctgggggctccgggatcgttggatccgatgtatcgccagtggtttattgaagcggattcagaatcggaacagatccgtgtgattgttgatcagattgcgtcgatgacggagtctcgtctggaacgccttgcccggaatgctgctgacatctcaggatttttgggataattggttagagcagcagtaag

SEQ ID NO: 1036 - protein, 424 aa, Corynebacterium glutamicum
MYPYSDADAFRRQPERAKSSQLRTSAVDTRSAFARDRARVLHSAALRRLADKTQVVGPNDGDTPRTRLTHSLEVAQIARGIGAGLDLDPDLCDLAGLCHDIGHPPYGHNGENALNEVAAACGGFEGNAQTLRILTRLEPKIVSDEGESFGLNLSRAALDAACKYPWAKTNADGSVNKKYSAYDEDAEILAWIRQGHEDLRPPIEAQVMDFSDDIAYSVHDVEDGIVSGRIDLKVLWDLVELAALADKGAAAFGGSPAELIEGAASLRELPVVAAAADFDFSLRSYAALKAMTSELVGRYVGSTIESTKKTHAGIDVGRMHGDLIIPETAASEVKLLKTLAVLYVMDDPGHLARQNRQRDRIFRVFDYLVLGAPGSLDPMYRQWFIEADSESEQIRVIVDQIASMTESRLERLARNAADISGFLG

SEQ ID NO: 1037 - DNA, 1131 bp, Corynebacterium glutamicum
  CDS (101)..(1108): RXN01027
aatagatggaagtagtttttcattcacttatgtgcgcgtttttaatctggtttctaccaagaactgtgtgcaccacaacgcggaaggtgaatcgcacccaatggcaaataagaacaataagcctcatgaggtggacaaagaccaagattcagccatgctgatcaacggtcgcctgcaacagatcccggcgcgtcccactgaggaattcacccgcccaactcttgcagcaggtgcagtactgtggcgcggcgacatcaccaacccggacagcatcgaggtcgctgtcatccaccgcccgcactatgatgactggtccctggccaagggcaaagtcgatcccggcgagtctattccgacaaccgcggcccgtgaaatccttgaagaaactggctacgacatccgtctgggcaagctgatcggcaaggttacttaccctgtgctcgaccgaaccaaagtggtctactactggactgcccaggttcttggtggagagtttgtccccaacgatgaagttgatgaaatccgttggctgtctgttgatgaagcatgcgagttgctcagctaccaagtagataccgaagttctggccaaggcagcaaagcgtttccgcactccttccaccactcgggtgctgtatgttcgccatgctcatgcacatggtcgccaaacctggggtggcgacgacaataagcgcccattggacaaaaaggggcgtcgacaagcagaaatgctcgtacccatgttgttgcccttcaaacccaccgcaatttactcggcggtgcccgatcgctgccaagccaccgcgctcccccttgccgatgagctcggcctcgacgtgtccgtcaaccgactgttcggcgacgacgcctgggaaaccgatcccgaggcctgcaagaagcgcttcaccgacgtggtcgcgcaaggtggcgtgccgatgatcgttgggcagggcgacatcattccggaaatgatcaaatggttctccgagaacggcaccctccctatcgatgagaagatcaaggcgaaaaagggcagcgtgtgggtgttgagctttcacgacggtgtgttcaccggcgctgattacctggcgagttccctgccggttaaataggagcgcgtttaaggcctcca

SEQ ID NO: 1038 - protein, 336 aa, Corynebacterium glutamicum
MANKNNKPHEVDKDQDSAMLINGRLQQIPARPTEEFTRPTLAAGAVLWRGDITNPDSIEVAVIHRPHYDDWSLAKGKVDPGESIPTTAAREILEETGYDIRLGKLIGKVTYPVLDRTKVVYYWTAQVLGGEFVPNDEVDEIRWLSVDEACELLSYQVDTEVLAKAAKRFRTPSTTRVLYVRHAHAHGRQTWGGDDNKRPLDKKGRRQAEMLVPMLLPFKPTAIYSAVPDRCQATALPLADELGLDVSVNRLFGDDAWETDPEACKKRFTDVVAQGGVPMIVGQGDIIPEMIKWFSENGTLPIDEKIKAKKGSVWVLSFHDGVFTGADYLASSLPVK

SEQ ID NO: 1039 - DNA, 757 bp, Corynebacterium glutamicum
  CDS (101)..(757): FRXA01024
aatagatggaagtagtttttcattcacttatgtgcgcgtttttaatctggtttctaccaagaactgtgtgcaccacaacgcggaaggtgaatcgcacccaatggcaaataagaacaataagcctcatgaggtggacaaagaccaagattcagccatgctgatcaacggtcgcctgcaacagatcccggcgcgtcccactgaggaattcacccgcccaactcttgcagcaggtgcagtactgtggcgcggcgacatcaccaacccggacagcatcgaggtcgctgtcatccaccgcccgcactatgatgactggtccctggccaagggcaaagtcgatcccggcgagtctattccgacaaccgcggcccgtgaaatccttgaagaaactggctacgacatccgtctgggcaagctgatcggcaaggttacttaccctgtgctcgaccgaaccaaagtggtctactactggactgcccaggttcttggtggagagtttgtccccaacgatgaagttgatgaaatccgttggctgtctgttgatgaagcatgcgagttgctcagctaccaagtagataccgaagttctggccaaggcagcaaagcgtttccgcactccttccaccactcgggtgctgtatgttcgccatgctcatgcacatggtcgccaaacctggggtggcgacgacaataagcgcccattggacaaaaaggggcgtcgacaagcagaaatgctcgtacccatgttgttgcccttcaaa

SEQ ID NO: 1040 - protein, 219 aa, Corynebacterium glutamicum
MANKNNKPHEVDKDQDSAMLINGRLQQIPARPTEEFTRPTLAAGAVLWRGDITNPDSIEVAVIHRPHYDDWSLAKGKVDPGESIPTTAAREILEETGYDIRLGKLIGKVTYPVLDRTKVVYYWTAQVLGGEFVPNDEVDEIRWLSVDEACELLSYQVDTEVLAKAAKRFRTPSTTRVLYVRHAHAHGRQTWGGDDNKRPLDKKGRRQAEMLVPMLLPFK

SEQ ID NO: 1041 - DNA, 257 bp, Corynebacterium glutamicum
  CDS (1)..(234): FRXA01027
accgatcccgaggcctgcaagaagcgcttcaccgacgtggtcgcgcaaggtggcgtgccgatgatcgttgggcagggcgacatcattccggaaatgatcaaatggttctccgagaacggcaccctccctatcgatgagaagatcaaggcgaaaaagggcagcgtgtgggtgttgagctttcacgacggtgtgttcaccggcgctgattacctggcgagttccctgccggttaaataggagcgcgtttaaggcctcca

SEQ ID NO: 1042 - protein, 78 aa, Corynebacterium glutamicum
TDPEACKKRFTDVVAQGGVPMIVGQGDIIPEMIKWFSENGTLPIDEKIKAKKGSVWVLSFHDGVFTGADYLASSLPVK

SEQ ID NO: 1043 - DNA, 651 bp, Corynebacterium glutamicum
  CDS (101)..(628): RXA01528
cacccaaacccaaacctctcagtcgaataagcagaagtctcaggacaaccgcaggggtaagggtcgtaggtctccaaccaggaggcgttccaacacgagggtgaatcaggcgtggcagcagtcccgtttggttacttctgatgagacttccgcaggtggtctcgtggtgtcaggtttggctgaggcggtcaacgctaacaatgaggttgatctgtcgaagatttatgttgcgttgattggtcgccttgatcgtcgtggtcgtttgttgtggtcgatgccgaagggccatgttgagcctggtgaggataaggctgcgactgctgagcgtgaggtgtgggaggagaccggcatccacggtgaggtgttcactgagttgggtgtgattgattattggttcgtttcggaagggaagcggatccataagacggtgcatcatcatttgttgcgttatgttgatggcgatttgaatgatgaggatccagaagtcactgaggtggcgtggattccggcgaatcagttgattgagcatttggcttttgcggatgagcggaagttggctaggcaggcgcatgatttgttgcctgagtttgctttgaaggaaaaggcggagggaaggtccaccccaaggtgattccgaaccccaacccgaac

SEQ ID NO: 1044 - protein, 176 aa, Corynebacterium glutamicum
VNQAWQQSRLVTSDETSAGGLVVSGLAEAVNANNEVDLSKIYVALIGRLDRRGRLLWSMPKGHVEPGEDKAATAEREVWEETGIHGEVFTELGVIDYWFVSEGKRIHKTVHHHLLRYVDGDLNDEDPEVTEVAWIPANQLIEHLAFADERKLARQAHDLLPEFALKEKAEGRSTPR

SEQ ID NO: 1045 - DNA, 541 bp, Corynebacterium glutamicum
  CDS (101)..(541): RXA00072
acggccaggacgatccagtgcacaggccagcaccagcaaagtccacatcgcaagcattaaaagaatctctcgaaagacacaaaagaggtgagtcgcaacaatgagctttcaactagttaacgccctgaaaaatactggttcggtaaaagatcccgagatctcacccgaaggacctcgcacgaccacaccgttgtcaccagaggtagcaaaacataacgaggaactcgtcgaaaagcatgctgctgcgttgtatgacgccagcgcgcaagagatcctggaatggacagccgagcacgcgccgggcgctattgcagtgaccttgagcatggaaaacaccgtgctggcggagctggctgcgcggcacctgccggaagctgatttcctctttttggacaccggttaccacttcaaggagacccttgaagttgcccgtcaggtagatgagcgctattcccagaagcttgtcaccgcgctgccgatcctcaagcgcacggagcaggattccatttatggtctcaacctgtaccgcagcaacccagcg

SEQ ID NO: 1046 - protein, 147 aa, Corynebacterium glutamicum
MSFQLVNALKNTGSVKDPEISPEGPRTTTPLSPEVAKHNEELVEKHAAALYDASAQEILEWTAEHAPGAIAVTLSMENTVLAELAARHLPEADFLFLDTGYHFKETLEVARQVDERYSQKLVTALPILKRTEQDSIYGLNLYRSNPA

SEQ ID NO: 1047 - DNA, 1002 bp, Corynebacterium glutamicum
  CDS (101)..(979): RXA01878
ggttcaggctgcacaaggttggggagcatggcctgcttgcaccgcaagcttgggcatccgatagtagaaatctggcatccaataggtagattgggatgctatggaagaaccctcaggtgcacagctgctcggcccggtagaaatccgtgcgctggcagaaaagctcgacgtcacaccaactaagaagttggggcagaactttgttcacgatcccaacacggtgcgtcgcattgttgctgcggcagagctcaccccaaacgaccacgtggtggaagttggccctggtctgggctctctgacccttgccctggtggaatctgctgcttcagtaactgcggtggaaattgatccccgtttggctgcggaattgccggagacttttcagtggcgcgcgccggcccttgctcacaagttgagcatcgtgctgaaagacgccctgaaggttcaacaatccgatatggctgttcaacccaccgccttggtggctaacttgccgtacaacgtctctgtccctgtcttgttgcacatgatggaggagtttcccaccatcaacaaggtgcttgtcatggtgcaggcagaggttgctgatcgtttggctgcggatccaggatcgaagatttatggtgtgcctagcgtgaaggcgtccttctacggtccagttactcgcgccgggtcgattggtaagaatgtcttttggccagctccaaagatcgaatccggtttggtgaagatcgtgcgcgaagacaccgcgtggaagcaggacgatgagacgcgtaagaaggtgtggccgatcattgatgctgctttcttgcagcgccgtaaaaccctaagagctgcgctttctggacactacggttctggccaggcagctgaggaagctttgcgggccgctgatattgatccaacgcttcgtggcgaaaagcttgatgtcactgactatgtgcgcctagctggggtgttgcagcaaaaggatgagaagtgaaaattaccgctaaggcgtgg

SEQ ID NO: 1048 - protein, 293 aa, Corynebacterium glutamicum
MEEPSGAQLLGPVEIRALAEKLDVTPTKKLGQNFVHDPNTVRRIVAAAELTPNDHVVEVGPGLGSLTLALVESAASVTAVEIDPRLAAELPETFQWRAPALAHKLSIVLKDALKVQQSDMAVQPTALVANLPYNVSVPVLLHMMEEFPTINKVLVMVQAEVADRLAADPGSKIYGVPSVKASFYGPVTRAGSIGKNVFWPAPKIESGLVKIVREDTAWKQDDETRKKVWPIIDAAFLQRRKTLRAALSGHYGSGQAAEEALRAADIDPTLRGEKLDVTDYVRLAGVLQQKDEK

SEQ ID NO: 1049 - DNA, 1545 bp, Corynebacterium glutamicum; identical to SEQ ID NO: 969
  CDS (101)..(1531): RXN02281

SEQ ID NO: 1050 - protein, 477 aa, Corynebacterium glutamicum; identical to SEQ ID NO: 970

SEQ ID NO: 1051 - DNA, 1191 bp, Corynebacterium glutamicum; identical to SEQ ID NO: 971
  CDS (101)..(1168): FRXA02281

SEQ ID NO: 1052 - protein, 356 aa, Corynebacterium glutamicum; identical to SEQ ID NO: 972

SEQ ID NO: 1053 - DNA, 1146 bp, Corynebacterium glutamicum
  CDS (101)..(1123): RXN01240
ttgttctcacatctacccgtatctttgttggttttagtacccgatagtgagttttgatccctgcacaggaaagttagcggcgctactatgaacgatcgatatgtctgacaacactctctcccaatttggcagttactaccacgaattccgacgtgcccatcccatggccgacgtcgaattcctcctagcaattgaagaattacttacggacggtggtgtcaccttcgatcgcgtcaccacacgcatcaaagaatggtcaagcctgaaagccaaggctcgcaagcgtcgcaacgatggctcgttgatctaccctgatccgcgcaaagacatccacgacatgatcggtgttcggatcaccacgtaccactccacggaaatacccgtggccctaaaagtgctccaagactccttcatcgtccacaaatccgtagacaaagccgctgaaactcgcatctcaggcggctttggttacggctcccaccacctgattctggaagtcgatgacacctccgatgacctccaggactacaaaggcctcgtctttgaagttcaggtgcgcaccgtgctgcaacacgcctgggcagagttcgaacacgatatccgctataaacgcgccgatgtgtccaacccagaagacttcagcgcagaagtagaccgcatgttcaccctcgctgccggactcatcgaattagcggaccaacaattcgaccaaatcgccgcactcaaagaaaccagccgagttgctgatgaatccgtcgaactcaccgcagagacacttcccggcgttcttgccatgctcattggcaaccgcttcccccgcccacgctccacaaactaccgcttcctcgaagacatcctggtggccaactccattacctctgtggtgcagctgcgcgagctgctcaaccccaccgacattgaagtgctgttgaaagtaatgaactaccgcttccacccaggccagatccgcatcatcgacgatttactactcaaacgatttggccaatcacacatcgatgccaccgtcgccaccgactcccaaccactcaacgccaaacgccacaggcagctaaaacgcaagctagagctcatgacccaagctcatcttgtggaaccaccaaactaaagttcccccaaagttagccc

SEQ ID NO: 1054 - protein, 341 aa, Corynebacterium glutamicum
MSDNTLSQFGSYYHEFRRAHPMADVEFLLAIEELLTDGGVTFDRVTTRIKEWSSLKAKARKRRNDGSLIYPDPRKDIHDMIGVRITTYHSTEIPVALKVLQDSFIVHKSVDKAAETRISGGFGYGSHHLILEVDDTSDDLQDYKGLVFEVQVRTVLQHAWAEFEHDIRYKRADVSNPEDFSAEVDRMFTLAAGLIELADQQFDQIAALKETSRVADESVELTAETLPGVLAMLIGNRFPRPRSTNYRFLEDILVANSITSVVQLRELLNPTDIEVLLKVMNYRFHPGQIRIIDDLLLKRFGQSHIDATVATDSQPLNAKRHRQLKRKLELMTQAHLVEPPN

SEQ ID NO: 1055 - DNA, 1234 bp, Corynebacterium glutamicum
  CDS (101)..(1234): RXN02008
tactggtctatctatcaaaagatgatcgttcgcggtcgtgattttgacgatatttttgatcttgttggcatccgcatcctggtagacaacgtgaacaactgtgtacgccgccatcggtgtcgtgcactccctgttcaatgctctgcctggccgattcaaagactatatttcagccccgcgcttcggtgtctaccaatccctgcacaccaccgtgatgggacctggcggtaagcctctggaagttcaggcacgtacccacgacatgcactacaacgccgaattcggcattgcagcgcactggcgatacaaagaaaccaaaggcagccacagtggcgagcaagccgaagtggatcaaatggcgtggatgcgccaacttctggactggcaaaaagaagcagccgaccccaacgagttcctggacagcctgcgctacgatctgacttccaagcagatcttcgtgttcacacccaaaggtgatgtggtcaacctgccggtgaactccaccccggtggacttcgcctacgcggtgcacaccgaagtggggcaccgctgcatcggcgccaaaatcaacggcaaactggtcgctttggaaacgaaactcaaatccggcgatcgtgttgaagtctttacctccaaggaccaaaacgctggcccaagtaggggatggcaagaatttgttgtctcacctcgtgcaaaggccaagattcgccagtggtttgccaaggaacgacgcgaagaatacctagaagccggacgcgatgcgctggcagcagttattcagcgtggcggcctgccaatgcaccgcttgttcaccgcgtcctccatgaagacggtggcaacagagctgcactacccagatgtagatgcgctctacacagccatcggctccggttctgtatctgcgcaacacgtagtcaaccgtctcatggctatctttggtgacgaagaagatgccgaagacgcattggttgcacgcaccccattcagcgagctggtcaactcccgtgccaccacggaaagcagcaccggcatcctggtcgaaggcagcccagatgtcatggctaagctcgctaaatgctgtatgccagtgccaggagatgaaatctttggattcgtcacccgtggtggcggtgtctccgtacaccgaacagactgcacgaatgtggaaaagctcaaagaagagccagaacgcattgtctccgtctcctgggcttcggaaggtcaaggttcagta

SEQ ID NO: 1056 - protein, 378 aa, Corynebacterium glutamicum
VYAAIGVVHSLFNALPGRFKDYISAPRFGVYQSLHTTVMGPGGKPLEVQARTHDMHYNAEFGIAAHWRYKETKGSHSGEQAEVDQMAWMRQLLDWQKEAADPNEFLDSLRYDLTSKQIFVFTPKGDVVNLPVNSTPVDFAYAVHTEVGHRCIGAKINGKLVALETKLKSGDRVEVFTSKDQNAGPSRGWQEFVVSPRAKAKIRQWFAKERREEYLEAGRDALAAVIQRGGLPMHRLFTASSMKTVATELHYPDVDALYTAIGSGSVSAQHVVNRLMAIFGDEEDAEDALVARTPFSELVNSRATTESSTGILVEGSPDVMAKLAKCCMPVPGDEIFGFVTRGGGVSVHRTDCTNVEKLKEEPERIVSVSWASEGQGSV

SEQ ID NO: 1057 - DNA, 1059 bp, Corynebacterium glutamicum
  CDS (101)..(1036): RXN01940
ccagaatcaatcaccgatacagtggcagccaaagtccaggctgaagaagccgctcaagccgccagctaaatccacaaactgaactaaggagttttaccctatgaccaccaagatcatcctcgactgcgatccaggacacgacgacgctgtagccatgctgctcgcagccggcagcccagaaattgaactgcttggaatcaccacggtcggcggcaaccagaccttggacaaggtcacccacaatacgcaggtcgtagccaccatcgctgatatcaatgcgcccatctaccgcggtgtcacccgaccattggtgcgccccgttgaggtagccgaagatatccacggcgataccggcatggaaatccacaagtacgaactgcctgaaccaaccaagcaggtagaagacacccacgcggtggatttcatcatcgataccatcatgaataacgagcccggcagcgtagcgctggttcccaccggaccactgaccaacatcgcgctggcagtccggaaagaaccacgcatcgccgagcgagtcaaggaagttgtcctcatgggcgggggctaccacgtaggaaactggaccgccgtagctgaattcaacatcaagatcgaccccgaagcagcccacatcgtattcaacgaaaagtggccactgactatggtcggcctcgaccttacccaccaggcgctcgcaacacctgagatcgaagccaagttcaacgagctgggcaccgacgtcgccgacttcgtcgtcgcgcttttcgacgctttccgcaagaattaccaggacgcacagggttttgataacccaccagtacacgacccttgtgctgttgcataccttgttgacccaaccgtattcaccacccgcaaagcaccactcgatgtggagctgtacggcgcactcaccacaggcatgaccgttgctgatttccgcgcaccggctccagcagattgcaccacccaagtagctgttgacctggactttgataaattctggaacatggtgatcgatgcagtaaagcgcatcggatagacctgttcacaaggttgtta

SEQ ID NO: 1058 - protein, 312 aa, Corynebacterium glutamicum
MTTKIILDCDPGHDDAVAMLLAAGSPEIELLGITTVGGNQTLDKVTHNTQVVATIADINAPIYRGVTRPLVRPVEVAEDIHGDTGMEIHKYELPEPTKQVEDTHAVDFIIDTIMNNEPGSVALVPTGPLTNIALAVRKEPRIAERVKEVVLMGGGYHVGNWTAVAEFNIKIDPEAAHIVFNEKWPLTMVGLDLTHQALATPEIEAKFNELGTDVADFVVALFDAFRKNYQDAQGFDNPPVHDPCAVAYLVDPTVFTTRKAPLDVELYGALTTGMTVADFRAPAPADCTTQVAVDLDFDKFWNMVIDAVKRIG

SEQ ID NO: 1059 - DNA, 602 bp, Corynebacterium glutamicum
  CDS (1)..(579): FRXA01940
agagtaacgcttgtttccaccgggccactgaccaacatcgcgctggcagtccggaaagaaccacgcatcgccgagcgagtcaaggaagttgtcctcatgggcgggggctaccacgtaggaaactggaccgccgtagctgaattcaacatcaagatcgaccccgaagcagcccacatcgtattcaacgaaaagtggccactgactatggtcggcctcgaccttacccaccaggcgctcgcaacacctgagatcgaagccaagttcaacgagctgggcaccgacgtcgccgacttcgtcgtcgcgcttttcgacgctttccgcaagaattaccaggacgcacagggttttgataacccaccagtacacgacccttgtgctgttgcataccttgttgacccaaccgtattcaccacccgcaaagcaccactcgatgtggagctgtacggcgcactcaccacaggcatgaccgttgctgatttccgcgcaccggctccagcagattgcaccacccaagtagctgttgacctggactttgataaattctggaacatggtgatcgatgcagtaaagcgcatcggatagacctgttcacaaggttgtta

SEQ ID NO: 1060 - protein, 193 aa, Corynebacterium glutamicum
RVTLVSTGPLTNIALAVRKEPRIAERVKEVVLMGGGYHVGNWTAVAEFNIKIDPEAAHIVFNEKWPLTMVGLDLTHQALATPEIEAKFNELGTDVADFVVALFDAFRKNYQDAQGFDNPPVHDPCAVAYLVDPTVFTTRKAPLDVELYGALTTGMTVADFRAPAPADCTTQVAVDLDFDKFWNMVIDAVKRIG

SEQ ID NO: 1061 - DNA, 1026 bp, Corynebacterium glutamicum
  CDS (101)..(1003): RXA02559
ttagtcctctatggcagcaagcctgccagaggagcctatccagcactagaccccaactagaacccaaccccaaaaccagaaaacactaagctcgtgagacatgattcctgttctcatcgactgcgacaccggcatcgacgacgccctcgccctgatctacctggttgctttgcataaacgtggtgaaatccaactttttggagcaacgaccaccgcaggaaatgttgatgtgaaacaaaccgccatcaataccaggtgggtgttggatcagtgtggattagcggacatcccggtcctcgcaggacaacctgaaccaaagcacgtgccgctagtgactactccagaaacacacggcgaccatggccttggttatataaacccaggtcacgtcgaaattccagaaggtgactggaagcagctgtggaaagaacacctcagtaacccagaaactaagctgattgtcaccgggcccgccaccaaccttgcggaattcgggccagtggaaaacgtcacgctgatgggtggcacctacctttatccaggcaacaccactccaacggcagaatggaatacctgggttgatccacacggagctaaagaagcattcgcggcagcccaaaagcccattacggtgtgttccttgggcgtgaccgagcagtttacgctgaacccggacatcctttctacacttatcaacacgcttggcagccaacccatcgcagagcatttacctgagatgctgcgcttttactttgaatttcacgaagtgcagggcgaaggttaccttgctcaaattcatgacctgctgacctgcatgattgccttggataaaatcccattttcaggccgtgaagtaaccgtggacgtggaggctgattcgcccttgatgcgtggcaccactgttgcagatattcgcggacattggggcaagccagctaacgcatttcttgtggaaaccgcagacattgaggccgcccacgcggaacttctaagagcagtggaatgaaataatccggtgctgatgca

SEQ ID NO: 1062 - protein, 301 aa, Corynebacterium glutamicum
MIPVLIDCDTGIDDALALIYLVALHKRGEIQLFGATTTAGNVDVKQTAINTRWVLDQCGLADIPVLAGQPEPKHVPLVTTPETHGDHGLGYINPGHVEIPEGDWKQLWKEHLSNPETKLIVTGPATNLAEFGPVENVTLMGGTYLYPGNTTPTAEWNTWVDPHGAKEAFAAAQKPITVCSLGVTEQFTLNPDILSTLINTLGSQPIAEHLPEMLRFYFEFHEVQGEGYLAQIHDLLTCMIALDKIPFSGREVTVDVEADSPLMRGTTVADIRGHWGKPANAFLVETADIEAAHAELLRAVE

SEQ ID NO: 1063 - DNA, 1050 bp, Corynebacterium glutamicum
  CDS (101)..(1027): RXA02497
tcgatgccgccgctggcgaagactcggggaaacctaaaaataccgaagaagaatttgaccgattcacactttgccaccctagaccgtctaacctttaggtgtgagattaggtgtattagatgtgggcagcaatactgtccacctagttgcagtagacgcgcgtcccggtggacaccccaccccgatgagcaattggcgtaccccactgcgccttgttgagcttcttgatgactccggggcgatctccgaaaagggcatcaacaaactcacctcagcagtcggggaagcagcagacctagcgaaaacgctcggctgcgctgaactgatgccatttgctacatcggcagtccgctccgccaccaacagcgaggcagtgctcgaccacgtggagaaggaaaccggcgtccgcctgtccatcctttccggtgaagacgaagcacgccaaactttcctcgcagttcgacgttggtatggatggtccgcagggcgcataactaacctcgacatcggtggcggctccctggaactatcctccggaaccgacgaatccccagacctcgcgttctcactggatctgggtgcgggccgcttgacccacaactggttcgacaccgatccaccggcacgtaagaaaatcaacctcctgcgcgattatatcgatgcggaacttgcagaacccgcccgccagatgcgcaccctagggcccgcgcgcctggcagtgggaacatccaaaactttccgcaccctggcacgactgactggtgctgcgccctcatccgcaggaccacacgtcacccgaaccctcaccgcgccgggtctgcgccagctgatcgcatttatctcacgaatgactgcggcggaccgcgctgagctggaaggtatcagctcggatcggtcacatcagatcgtggcaggtgcgctagttgcggaagctgcgatgcgtgcgttggatattgacaaggtagaaatttgtccgtgggcacttcgtgaaggtgtgatcctcaccaggatcgacaaaggactcgagtaacatttacccggaaaggagtt

SEQ ID NO: 1064 - protein, 309 aa, Corynebacterium glutamicum
VRLGVLDVGSNTVHLVAVDARPGGHPTPMSNWRTPLRLVELLDDSGAISEKGINKLTSAVGEAADLAKTLGCAELMPFATSAVRSATNSEAVLDHVEKETGVRLSILSGEDEARQTFLAVRRWYGWSAGRITNLDIGGGSLELSSGTDESPDLAFSLDLGAGRLTHNWFDTDPPARKKINLLRDYIDAELAEPARQMRTLGPARLAVGTSKTFRTLARLTGAAPSSAGPHVTRTLTAPGLRQLIAFISRMTAADRAELEGISSDRSHQIVAGALVAEAAMRALDIDKVEICPWALREGVILTRIDKGLE

SEQ ID NO: 1065 - DNA, 2226 bp, Corynebacterium glutamicum
  CDS (101)..(2203): RXN01079
accttaaaacttaatcaatcaatacaaagttcacacctcttttgaaagggacattcctttgactgcatcgggaaccaccgtcgtgccacgcggagaccagatggacttccacgctcttaacgcgttgctcaacctttacgatgacaacggcaagatccagtttgagaaagaccgtgaagctgcaaaccagtacttcctgcagcacgtcaaccagaacaccgtcttcttccacaacctgcaggaaaagatcgactacctggttgaaaacaagtactatgacccaatcgttctggacaagtacgacttccagttcatcaaggacctcttcaagcgcgcatacggattcaagttccgcttccagtccttcctcggtgcatacaagtactacacttcctacaccctgaagaccttcgacggtcgccgctacctcgagcgtttcgaagaccgtgtctgcatggtcgccctcaccctcgctgacggcgaccgcgcattggccgagaacctggtcgatgagatcatgtctggccgtttccaaccagcaaccccaaccttcctgaactccggcaaggcacagcgcggcgagccagtatcctgcttcctcctgcgtatcgaagacaacatggagtccatcggacgttccatcaactctgctcttcagctgtccaagcgtggcggtggcgtagcgttgctgctgtccaaccttcgtgaagccggtgcaccgattaagaagattgaaaaccagtcttccggtgttatcccagtgatgaaacttctggaagatgctttctcctacgctaaccagctgggtgctcgtcagggtgcaggtgctgtgtacctcaacgctcaccacccagatatcctgtccttcctggataccaagcgtgagaacgccgatgagaagatccgcatcaagaccctgtccctgggtgttgtgattccggacatcaccttcgagctggctaagcgcaacgatgacatgtacctgttctccccatacgatgtggagcgcatttacggcaagcctttcgcagacgtctcaatcaccgagcactacgacgagatggtggatgatgaccgcatccgcaagaccaagatcaacgcgcgtcagttcttccagaccctggcagaaatccagttcgagtccggttacccatacatcatgtatgaagacaccgtgaatgcatccaacccaatcgaaggtcgcatcacccactcaaacctgtgctctgagatccttcaggtgtccaccccatctgaattcaacgatgacctgacttacgcagaggtcggcgaagacatttcttgtaacttgggttccctcaacgttgcaatggctatggatgcaccaaactttgagaagaccatcgaaaccgaaatccgcggcttaactgcagtgcctgagcagaccagcatcgattccgtgccttccatccgtaagggcaacgaagcagctcacgccatcggccttggccagatgaaccttcacggctacttcggtcgcgagcacatgcactacggctccgaggaagccctggacttcaccaacgcatactttgctgccgtgctgtaccagtgcctgcgtgcatccaaccagatcgctactgagcgtggagagcgtttcaagaacttcgaaaactccaagtatgcaaccggtgagtacttcgatgatttcgatgcaaacgacttcgcaccaaagtccgacaaggtcaaggaactctttgccaagtcgaacatccacaccccaaccgttgaggactgggctgcgctgaaggccgacgtgatggagcacggtctgttcaaccgtaacctgcaagcggttccaccaaccggttcgatctcctacatcaacaactccacctcgtcgatccacccaatcgcatccaagattgagatccgcaaggaaggcaagatcggccgcgtttactacccagctccacacatggacaatgacaaccttgagtacttcgaggacgcctacgaaatcggctacgagaagatcattgacacctacgctgtggcaaccaagtacgttgaccagggcctgtcactgaccttgttcttcaaggacactgccaccacccgtgacatcaaccgtgcgcagatctacgcatggcgcaagggcatcaagaccttgtactacattcgcctgcgccaggttgctctggaaggcactgaagttgacggctgcgtcagctgcatgctgtaaaagcacttaaaaatatcccc

SEQ ID NO: 1066 - protein, 701 aa, Corynebacterium glutamicum
MDFHALNALLNLYDDNGKIQFEKDREAANQYFLQHVNQNTVFFHNLQEKIDYLVENKYYDPIVLDKYDFQFIKDLFKRAYGFKFRFQSFLGAYKYYTSYTLKTFDGRRYLERFEDRVCMVALTLADGDRALAENLVDEIMSGRFQPATPTFLNSGKAQRGEPVSCFLLRIEDNMESIGRSINSALQLSKRGGGVALLLSNLREAGAPIKKIENQSSGVIPVMKLLEDAFSYANQLGARQGAGAVYLNAHHPDILSFLDTKRENADEKIRIKTLSLGVVIPDITFELAKRNDDMYLFSPYDVERIYGKPFADVSITEHYDEMVDDDRIRKTKINARQFFQTLAEIQFESGYPYIMYEDTVNASNPIEGRITHSNLCSEILQVSTPSEFNDDLTYAEVGEDISCNLGSLNVAMAMDAPNFEKTIETEIRGLTAVPEQTSIDSVPSIRKGNEAAHAIGLGQMNLHGYFGREHMHYGSEEALDFTNAYFAAVLYQCLRASNQIATERGERFKNFENSKYATGEYFDDFDANDFAPKSDKVKELFAKSNIHTPTVEDWAALKADVMEHGLFNRNLQAVPPTGSISYINNSTSSIHPIASKIEIRKEGKIGRVYYPAPHMDNDNLEYFEDAYEIGYEKIIDTYAVATKYVDQGLSLTLFFKDTATTRDINRAQIYAWRKGIKTLYYIRLRQVALEGTEVDGCVSCML

SEQ ID NO: 1067 - DNA, 790 bp, Corynebacterium glutamicum
  CDS (101)..(790): FRXA01079
accttaaaacttaatcaatcaatacaaagttcacacctcttttgaaagggacattcctttgactgcatcgggaaccaccgtcgtgccacgcggagaccagatggacttccacgctcttaacgcgttgctcaacctttacgatgacaacggcaagatccagtttgagaaagaccgtgaagctgcaaaccagtacttcctgcagcacgtcaaccagaacaccgtcttcttccacaacctgcaggaaaagatcgactacctggttgaaaacaagtactatgacccaatcgttctggacaagtacgacttccagttcatcaaggacctcttcaagcgcgcatacggattcaagttccgcttccagtccttcctcggtgcatacaagtactacacttcctacaccctgaagaccttcgacggtcgccgctacctcgagcgtttcgaagaccgtgtctgcatggtcgccctcaccctcgctgacggcgaccgcgcattggccgagaacctggtcgatgagatcatgtctggccgtttccaaccagcaaccccaaccttcctgaactccggcaaggcacagcgcggcgagccagtatcctgcttcctcctgcgtatcgaagacaacatggagtccatcggacgttccatcaactctgctcttcagctgtccaagcgtggcggtggcgtagcgttgctgctgtccaaccttcgtgaagccggtgcaccgattaagaagattgaaatccagtcttccggtgttatcccagtgatgaaacttctggaagatgctttctcc

SEQ ID NO: 1068 - protein, 230 aa, Corynebacterium glutamicum
MDFHALNALLNLYDDNGKIQFEKDREAANQYFLQHVNQNTVFFHNLQEKIDYLVENKYYDPIVLDKYDFQFIKDLFKRAYGFKFRFQSFLGAYKYYTSYTLKTFDGRRYLERFEDRVCMVALTLADGDRALAENLVDEIMSGRFQPATPTFLNSGKAQRGEPVSCFLLRIEDNMESIGRSINSALQLSKRGGGVALLLSNLREAGAPIKKIEIQSSGVIPVMKLLEDAFS

SEQ ID NO: 1069 - DNA, 1364 bp, Corynebacterium glutamicum
  CDS (1)..(1341): FRXA01084
  misc_feature 504, 534: n = a, t, c, or g
  VARIANT 168: Xaa = Ile or Met
  VARIANT 179: Xaa = Ser, Pro, Thr, or Ala
tcctttctggataccaagcgcgagaacgccgatgagaagatccgcatcaagaccctgtccctgggtgttgtgattccggacatcaccttcgagctggctaagcgcaacgatgacatgtacctgttctccccatacgatgtggagcgcatttacggcaagcctttcgcagacgtctcaatcaccgagcactacgacgagatggtggatgatgaccgcatccgcaagaccaagatcaacgcgcgtcagttcttccagaccctggcagaaatccagttcgagtccggttacccatacatcatgtatgaagacaccgtgaatgcatccaacccaatcgaaggtcgcatcacccactcaaacctgtgctctgagatccttcaggtgtccaccccatctgaattcaacgatgacctgacttacgcagaggtcggcgaagacatttcttgtaacttgggttccctcaacgttgcaatggctatggatgcaccaaactttgagaagaccatngaaaccgaaatccgcggcttaactgcagtgnctgagcagaccagcatcgattccgtgccttccatccgtaagggcaacgaagcagctcacgccatcggccttggccagatgaaccttcacggctacttcggtcgcgagcacatgcactacggctccgaggaagccctggacttcaccaacgcatactttgctgccgtgctgtaccagtgcctgcgtgcatccaaccagatcgctactgagcgtggagagcgtttcaagaacttcgaaaactccaagtatgcaaccggtgagtacttcgatgatttcgatgcaaacgacttcgcaccaaagtccgacaaggtcaaggaactctttgccaagtcgaacatccacaccccaaccgttgaggactgggctgcgctgaaggccgacgtgatggagcacggtctgttcaaccgtaacctgcaagcggttccaccaaccggttcgatctcctacatcaacaactccacctcgtcgatccacccaatcgcatccaagattgagatccgcaaggaaggcaagatcggccgcgtttactacccagctccacacatggacaatgacaaccttgagtacttcgaggacgcctacgaaatcggctacgagaagatcattgacacctacgctgtggcaaccaagtacgttgaccagggcctgtcactgaccttgttcttcaaggacactgccaccacccgtgacatcaaccgtgcgcagatctacgcatggcgcaagggcatcaagaccttgtactacattcgcctgcgccaggttgctctggaaggcactgaagttgacggctgcgtcagctgcatgctgtaaaagcacttaaaaatatcccc

SEQ ID NO: 1070 - protein, 447 aa, Corynebacterium glutamicum
  VARIANT 168: Xaa = Ile or Met
  VARIANT 179: Xaa = Ser, Pro, Thr, or Ala
SFLDTKRENADEKIRIKTLSLGVVIPDITFELAKRNDDMYLFSPYDVERIYGKPFADVSITEHYDEMVDDDRIRKTKINARQFFQTLAEIQFESGYPYIMYEDTVNASNPIEGRITHSNLCSEILQVSTPSEFNDDLTYAEVGEDISCNLGSLNVAMAMDAPNFEKTXETEIRGLTAVXEQTSIDSVPSIRKGNEAAHAIGLGQMNLHGYFGREHMHYGSEEALDFTNAYFAAVLYQCLRASNQIATERGERFKNFENSKYATGEYFDDFDANDFAPKSDKVKELFAKSNIHTPTVEDWAALKADVMEHGLFNRNLQAVPPTGSISYINNSTSSIHPIASKIEIRKEGKIGRVYYPAPHMDNDNLEYFEDAYEIGYEKIIDTYAVATKYVDQGLSLTLFFKDTATTRDINRAQIYAWRKGIKTLYYIRLRQVALEGTEVDGCVSCML

SEQ ID NO: 1071 - DNA, 1125 bp, Corynebacterium glutamicum
  CDS (101)..(1102): RXN01920
cttctgaagggcttcggttggggtaagctggcgatctgaaatcgcgctgcattgtggcgtcgaaaagcaaaaaaatttgtagaagggaagagcgcacctaatggctgctgattctgatctcagtgttcacgatgcttacttaaaggagcatgttgcacctgtaaaggcgatcaactggaactccatcccagattccaaagatcttgaagtctgggatcgtctgaccggtaacttctggctcccagaaaaggtcccagtatccaacgacatcaagagctggggaaccctcaacgaggttgaaaaagccgcaaccatgcgcgtgttcaccggacttaccctgctggacaccattcagggcactgtcggcgcaatctccctgcttccagacgcagattcactgcacgaagaagcggtgctaaccaacattgcgttcatggaatccgtgcacgcaaagagttactccaacatcttcatgactctggcctccaccgcggaaatcaacgatgcgttccgttggtctgaggaaaatgaaaacctgcagcgcaaggcaaagatcatcctgtcttactatgagggcgatgatccactaaagcgcaagatcgcctccgtgatcctggagtccttcctgttctactccggcttctacctcccaatgtattggtccagccactccaagctggccaacaccgccgacgtgatccgcctgatcatccgcgatgaggcagtgcacggctactacattggctacaagtatcaaaaggctgtcgcgaaggagactccagagcgtcaggaagagctgaaggagtacaccttcgatctgctctacgatctttacgataacgaaactcagtactccgaagatctctacgacgatcttggatggaccgaggatgttaagcgattccttcgctacaacgccaacaaggccctcaacaaccttggctacgaaggactcttcccagcggatgaaaccaaggtgtccccaaacatcttgtctgcgctgtcaccaaacgctgatgagaaccacgacttcttctccggctccggttcctcttacgttattggtaaggcagaaaacaccgaggatgatgactgggacttctaacttttaaaaagctgaagcgc

SEQ ID NO: 1072 - protein, 334 aa, Corynebacterium glutamicum
MAADSDLSVHDAYLKEHVAPVKAINWNSIPDSKDLEVWDRLTGNFWLPEKVPVSNDIKSWGTLNEVEKAATMRVFTGLTLLDTIQGTVGAISLLPDADSLHEEAVLTNIAFMESVHAKSYSNIFMTLASTAEINDAFRWSEENENLQRKAKIILSYYEGDDPLKRKIASVILESFLFYSGFYLPMYWSSHSKLANTADVIRLIIRDEAVHGYYIGYKYQKAVAKETPERQEELKEYTFDLLYDLYDNETQYSEDLYDDLGWTEDVKRFLRYNANKALNNLGYEGLFPADETKVSPNILSALSPNADENHDFFSGSGSSYVIGKAENTEDDDWDF

SEQ ID NO: 1073 - DNA, 437 bp, Corynebacterium glutamicum
  CDS (1)..(414): FRXA01920
gccgacgtgatccgcctgatcatccgcgatgaggcagtgcacggctactacattggctacaagtatcaaaaggctgtcgcgaaggagactccagagcgtcaggaagagctgaaggagtacaccttcgatctgctctacgatctttacgataacgaaactcagtactccgaagatctctacgacgatcttggatggaccgaggatgttaagcgattccttcgctacaacgccaacaaggccctcaacaaccttggctacgaaggactcttcccagcggatgaaaccaaggtgtccccaaacatcttgtctgcgctgtcaccaaacgctgatgagaaccacgacttcttctccggctccggttcctcttacgttattggtaaggcagaaaacaccgaggatgatgactgggacttctaacttttaaaaagctgaagcgc

SEQ ID NO: 1074 - protein, 138 aa, Corynebacterium glutamicum
ADVIRLIIRDEAVHGYYIGYKYQKAVAKETPERQEELKEYTFDLLYDLYDNETQYSEDLYDDLGWTEDVKRFLRYNANKALNNLGYEGLFPADETKVSPNILSALSPNADENHDFFSGSGSSYVIGKAENTEDDDWDF

SEQ ID NO: 1075 - DNA, 567 bp, Corynebacterium glutamicum
  CDS (101)..(544): RXA01080
ttcagttcttcccttcaacgcccttgaagggggaaactgataccagcaagcacactaggcttgcgcacaaacggtatttagaagggaagtgagttcgaggatgctaatcgtgtatttttcctcggccaccgacaacacgcatcgttttgtacaaaagctcgatttacccaacgtgcgcatccccctcactagggtggaagaaccgctgaaaatcaacgagccctacgtgctaatcaccccgacctatggtggtggagtctccatgactggagaaaactcccgcccggtcccaccacaagtcatcaggtttttaaatgatgaacacaaccgcagcttcatcagggcagttgttgcaggtggaaactcaaacttcggctccgattttgggttggcaggcgagatcatttccaagaaatgtaaagtgccctatgtctaccgtttcgagctcatgggcaatgaggaagatgtaagtatccttcgtggaggtcttactcaaaacgcccaagctttggggctggaaccacaagaaccagttacctcgcgataaaccttaaaacttaatcaatc

SEQ ID NO: 1076 - protein, 148 aa, Corynebacterium glutamicum
MLIVYFSSATDNTHRFVQKLDLPNVRIPLTRVEEPLKINEPYVLITPTYGGGVSMTGENSRPVPPQVIRFLNDEHNRSFIRAVVAGGNSNFGSDFGLAGEIISKKCKVPYVYRFELMGNEEDVSILRGGLTQNAQALGLEPQEPVTSR

SEQ ID NO: 1077 - DNA, 650 bp, Corynebacterium glutamicum
  CDS (1)..(627): RXA00867
ttcggcgacatggacttcaaggttgccggcaccgcagacttcatcaccgcacttcagctggacaccaagctggacggcattccttccaaggtgctctccgatgcgcttgagcaggcacgcgatgcccgactgaccatcctgaacaccatggctgatgtcatcaacggacctgatgagatgagcaagttcgctcctcgcatcaccaccgtgaagatcccagtggcaaagatcggtgagctgatcggaccaaagggtaagaacatcaacgctcttaccgaagagaccggcgcaaacatctccatcgaagatgacggcaccgtgttcatctctgcagctgacggcgcatctgctgaagcggcgatcgaaaagatcaacgctctggcgaacccacagctgccaaaggttggcgagcgcttcctcggaaccgtcgtcaagaccaccgcattcggagcattcgtttccttgctcccaggccgcgacggccttgttcacatctccaagctgggtaacggcaagcgagtagaaaaggtcgacgatgtggtgaaggttggcgagaagattcaggtcgaaatcgctgacatcgacaaccgcggcaagatctccttggtcccagttgttgaagaggactaattagttctggctagatcggg

SEQ ID NO: 1078 - protein, 209 aa, Corynebacterium glutamicum
FGDMDFKVAGTADFITALQLDTKLDGIPSKVLSDALEQARDARLTILNTMADVINGPDEMSKFAPRITTVKIPVAKIGELIGPKGKNINALTEETGANISIEDDGTVFISAADGASAEAAIEKINALANPQLPKVGERFLGTVVKTTAFGAFVSLLPGRDGLVHISKLGNGKRVEKVDDVVKVGEKIQVEIADIDNRGKISLVPVVEED

SEQ ID NO: 1079 - DNA, 630 bp, Corynebacterium glutamicum
  CDS (1)..(630): RXA01416
gctggcgcttccgaaaacgttgtcaaccgcgtcaaggacggtgcaccagcaccaaccgaaaagatcgtctccgacggccttgaagcagctaagccattcatcgacatcctgtgccgcgcacaggaaggtctggcacagcgcgttggaaacgcagccaaggaattcccactgttccctccatacaccgacgaggtgtactccgcagtggagcgcaaggtatccaagaagctagcttctttgctgaccctgaaggcaaagcaagagcgcgacgacgctaccaacgcctacatggaagaaatcgaagccgaactgcttccaaagttcgaggcttcctacagctcagcagctgaagcgtccaaggaaatccgtgcaggatacaacgctgtcatgaaggccatcgtgcgccgcatgatcctcaccgatcacttccgcatcgacggccgcggagtcaccgacatccgtgacctggcagtagaagttgagctcatcccacgtgcgcacggttcctccctcttcgagcgtggcgagacccagatccttggtgtcaccaccctggacatgctcaagatggaacagcaaatcgactccctggcaccaggcgatgcgaagcgctacatgcaccactacaac

SEQ ID NO: 1080 - protein, 210 aa, Corynebacterium glutamicum
AGASENVVNRVKDGAPAPTEKIVSDGLEAAKPFIDILCRAQEGLAQRVGNAAKEFPLFPPYTDEVYSAVERKVSKKLASLLTLKAKQERDDATNAYMEEIEAELLPKFEASYSSAAEASKEIRAGYNAVMKAIVRRMILTDHFRIDGRGVTDIRDLAVEVELIPRAHGSSLFERGETQILGVTTLDMLKMEQQIDSLAPGDAKRYMHHYN

SEQ ID NO: 1081 - DNA, 757 bp, Corynebacterium glutamicum
  CDS (101)..(757): RXA01486
agagaactggtaaggtttttaccgttctagaccgcagaaatcttcgcggcgacaccgatgatcgccgagcagaactaaacatgaggagacctactcgcatatgagcgatgtaaaggacttcgaagacaccgaatttggcctgatcgaggccgtcgcaaccatcgacaacggtgacttcggaacccgcaccatccgttttgaaaccggccaacttgcccgccaggcagatggtgcagtgaccacctacctcgacgatgacacgatgctgctggcaaccaccaccgcatccaaccagccacgcgagggctttgacttcttcccactgaccgtggacgttgaagagcgtatgtacgcagctggtcgcatccctggctctttcttccgtcgggagggtcgcccatccaccgaagctatcctggcttgccgtctcatcgaccgcccactgcgcccaacctttgttaagggcctgcgcaatgaggttcagatcgttgtcaccgtcatgtccatgaaccctgaggattactacgatgtcgtagcaatcaacggagcttccgcagcaacccgcatctccggacttcctgtctccggcgctgtcggtggcgttcgcatggcactggttggtgatgaaaagcacccagaaggccaatgggttgcattcccaacccacgctcaacatgagcagtccgtatttgaaatcgttgtggctggtcgcctcgtcgagcgcaagcgcggcaacaagaccttctccgacgtcgca

SEQ ID NO: 1082 - protein, 219 aa, Corynebacterium glutamicum
MSDVKDFEDTEFGLIEAVATIDNGDFGTRTIRFETGQLARQADGAVTTYLDDDTMLLATTTASNQPREGFDFFPLTVDVEERMYAAGRIPGSFFRREGRPSTEAILACRLIDRPLRPTFVKGLRNEVQIVVTVMSMNPEDYYDVVAINGASAATRISGLPVSGAVGGVRMALVGDEKHPEGQWVAFPTHAQHEQSVFEIVVAGRLVERKRGNKTFSDVA

SEQ ID NO: 1083 - DNA, 651 bp, Corynebacterium glutamicum
  CDS (101)..(628): RXA01678
tattgtccaggcgcaggaaaatatctcatagttcaacatcgcaaatatcaccgacttccacggctatatctctgcaactgcagctcaccccggtgcagcaatgctgaaatgtgcagtcgatgaagccgctggcggacgcgcccaagctttcgtatcctcaggcgataacattggtggcagcccgttccaatcctccattcttggtgatgaacccaccttggaagcactcaaccaaatgggtcttgattactcagcagtgggcaaccacgaatttgataaaggctacgcagacttaagcagtcgagtcgctgaccttgctgattttgattatctcggcgcaaacgttgagggcgaaaacccagatcttgcaccatatggaatttctcaccttgatggtgtgaaggttgctttcgtaggcaccgtatcccaagaaactccgatgttggtcaattctgaaggcattgagggaatcacgtttactgacccacttgaagcaaccaaccgtgtagctgatgaactcgtgggaagtggcgcagcagatgttgtcgttgcgctttaccacgaaggcattaccggcaccgaagcatggtcagaaaatatcgacgttgttttcgcaggtcacacccactaagttcgtgatctaggaaccga

SEQ ID NO: 1084 - protein, 176 aa, Corynebacterium glutamicum
MLKCAVDEAAGGRAQAFVSSGDNIGGSPFQSSILGDEPTLEALNQMGLDYSAVGNHEFDKGYADLSSRVADLADFDYLGANVEGENPDLAPYGISHLDGVKVAFVGTVSQETPMLVNSEGIEGITFTDPLEATNRVADELVGSGAADVVVALYHEGITGTEAWSENIDVVFAGHTH

SEQ ID NO: 1085 - DNA, 1359 bp, Corynebacterium glutamicum
  CDS (101)..(1336): RXA01679
cattaccggcaccgaagcatggtcagaaaatatcgacgttgttttcgcaggtcacacccactaagttcgtgatctaggaaccgacaacggtccactaatcatgcagtctggaaactacgggcacgcacttgccgatgtagatttcagcttcaaccacgacaccggtgagctcaccgtagatgatgcccgcatgctcggagtcgacgatatcaacgcgtgtgaaaacccagatgacaccattgcagatattgttgctcaggcggaacttgatgctggtgaagccggcaaagaagtagtagcgaccatcgatggcgattttctccgcgccagcgacgaaggagcagaatctggctccaactacggcgctgaatcccagctcgtcaacatgattgccagtgctgtgcgttggtccatgtccaccaataccgccaccaccgcagacattgggcttatgaacgccggaggactccacactgacctattcagcggcgatgttacctacgccgaagcttttgaaatccagcctttctccggtgaagattcatttgtcaccctcaagggatcagtcttcaaagatgcccttgaccagcagtgggaagaaggttctgcacgaccagtggcagcacttggcgtatccgacaacgtttcctacacctacgacatcaaccgtccaatcggtgaccgcgtcacttccgtgaccattgatgataccccacttgatccggaacgcgactacgttgttgcagcttccctgtacctccagtccggcaacgaaggtatgaccgcactgacccgcggaaccgcacctgcacaaaccggcatcgtggatgtacagtccaccatcggatacttgtccaacaacaatgtcaccccacgtactggtcaagcccagatttccatcaccccatccggtgagttcaatgcgggtgaaaccatcacccttgacatggcaggactccgctacacccaaggcgacactgccacggaagtaactgtcagccttcgagaagaaattgtttcagcaccaattgatcctcagctcggagaagctggctttggcgaagctggaaccgcgacagtgagcttggacattcctgcaaccctttcaggtactcaaaacctcgttgtcaccaccgataccggcacccgtatttccatgccagttgagattgttggcgcagaacaaccagcaccgcaaccagcaggttcctctgttttaggaactggagtgctcagtggactcctcggcattgttgtaggaattctaggaatggtcggtctggtgaactggattgacccaagcttcattcaacagatccagcagcaaatctttgcttaaatttagtaaaaagcatgcat

SEQ ID NO: 1086 - protein, 412 aa, Corynebacterium glutamicum
MQSGNYGHALADVDFSFNHDTGELTVDDARMLGVDDINACENPDDTIADIVAQAELDAGEAGKEVVATIDGDFLRASDEGAESGSNYGAESQLVNMIASAVRWSMSTNTATTADIGLMNAGGLHTDLFSGDVTYAEAFEIQPFSGEDSFVTLKGSVFKDALDQQWEEGSARPVAALGVSDNVSYTYDINRPIGDRVTSVTIDDTPLDPERDYVVAASLYLQSGNEGMTALTRGTAPAQTGIVDVQSTIGYLSNNNVTPRTGQAQISITPSGEFNAGETITLDMAGLRYTQGDTATEVTVSLREEIVSAPIDPQLGEAGFGEAGTATVSLDIPATLSGTQNLVVTTDTGTRISMPVEIVGAEQPAPQPAGSSVLGTGVLSGLLGIVVGILGMVGLVNWIDPSFIQQIQQQIFA

SEQ ID NO: 1087 - DNA, 1071 bp, Corynebacterium glutamicum
  CDS (101)..(1048): RXN01488
ccagcgcttaaggccggtcaccggccatcaagcttgtcacatcgggtgccttatgatggtgcccgaccttaaaaataaaaacctgaaaggttaaaaacgcatgagcaaaaaagccatccttgatatcgacaccggcatcgatgatgccctcgcacttgcctacgcactgggctcacctgaactagagctcattggtgtcaccaccacctacggtaacgtgctactcgaaaccggtgcagtcaatgacctggcactgcttgatctgttcggtgcaccagaagtacctgtgtacttgggtgagccacacgcacagaccaaggatggctttgaagttcttgagatctccgcgttcattcacggacaaaacggcatcggcgaagtcgagctgccagcaagcgagtcaaaggcactccccggcgcagtggatttcctcattgattccgtcaacacccacggcgatgacctggtgatcatcgcaactggtcccatgaccaacctgtctgcggcaatcgcaaaggatccaagctttgcttccaaggctcacgtggtcatcatgggtggcgccttgactgtcccaggcaacgtcagcacatgggcagaagcaaacatcaaccaggacccagatgcagcaaacgatctgttccgttccggtgcagatgtcaccatgatcggtcttgatgtcaccctgcagacccttcttaccaagaagcacactgcgcagtggcgcgaactgggcactccagctgctatcgcactggccgacatgactgattactacatcaaggcatatgagaccaccgcaccacacctgggcggttgcggcctgcacgacccactggcagtaggcgttgcagtggacccaagcctggtcactttgctccccatcaacctcaaggtagacattgagggcgagacccgtggacgcaccattggcgatgaagtccgcctcaacgatccagtgcgcacctcccgcgcagctgtcgccgtagacgtggatcgtttcctttctgaattcatgacccgcatcggccgagtcgcagcacagcagtaaaagcagctctggtgaaggtt

SEQ ID NO: 1088 - protein, 316 aa, Corynebacterium glutamicum
MSKKAILDIDTGIDDALALAYALGSPELELIGVTTTYGNVLLETGAVNDLALLDLFGAPEVPVYLGEPHAQTKDGFEVLEISAFIHGQNGIGEVELPASESKALPGAVDFLIDSVNTHGDDLVIIATGPMTNLSAAIAKDPSFASKAHVVIMGGALTVPGNVSTWAEANINQDPDAANDLFRSGADVTMIGLDVTLQTLLTKKHTAQWRELGTPAAIALADMTDYYIKAYETTAPHLGGCGLHDPLAVGVAVDPSLVTLLPINLKVDIEGETRGRTIGDEVRLNDPVRTSRAAVAVDVDRFLSEFMTRIGRVAAQQ

SEQ ID NO: 1089 - DNA, 366 bp, Corynebacterium glutamicum
  CDS (101)..(343): RXC00540
tctccctatctaagggctggctaggtttgaccagtggcaacagttacacttgtgctcgtaaaacattgtcctccccatttcttgagtaagggaaaataccgtggcccgtgtagttgtcaatgtcatgcctaaggctgagattctggatccccaggggcaggcggtacaccgcgccctcggacgtatcggagtttctggcgtttccgatgtccgtcagggaaagcgcttcgagcttgaggtagatgattccgtcaccgaagctgacctaaagaaaattgctgaaaccctcctcgcaaacaccgtcatcgaagacttcgatgtggtgggagttgaggtcgcgaagtgagcgccaaaatcggtgtcatt

SEQ ID NO: 1090 - protein, 81 aa, Corynebacterium glutamicum
VARVVVNVMPKAEILDPQGQAVHRALGRIGVSGVSDVRQGKRFELEVDDSVTEADLKKIAETLLANTVIEDFDVVGVEVAK

SEQ ID NO: 1091 - DNA, 498 bp, Corynebacterium glutamicum
  CDS (101)..(475): RXC00560
aaggacgacttctggggagcggtgtggattctcacggggattctcatgcggattatcagacatatggacactttaacggttcgtactaggctgatgcttcatgaggattgatccgctggaaacccggcaagccgtattggccgtcaaagactggattgaaggggagggagacgtcaaaaagcctggtcgtgcggcacttgccgccgcaactcgcctgagcgtccgactgctcgcgcaacacgcgccgggaaacagcgtggaggtgcgggtacccccatttgttgcggtgcaatgcatagaggggccaaaacatacacgcggcacaccacccaacgtggtggagaccgacgccaagacctggttacgcttagcacctgggcaaaccacatttgatgcagaatttgaaagcggaaaaattagcgcatcaggtacccgagccaaagagattgcggactggttaccagtggtcaaactttagatttcctaatgctcattagt

SEQ ID NO: 1092 - protein, 125 aa, Corynebacterium glutamicum
MRIDPLETRQAVLAVKDWIEGEGDVKKPGRAALAAATRLSVRLLAQHAPGNSVEVRVPPFVAVQCIEGPKHTRGTPPNVVETDAKTWLRLAPGQTTFDAEFESGKISASGTRAKEIADWLPVVKL

SEQ ID NO: 1093 - DNA, 1305 bp, Corynebacterium glutamicum
  CDS (101)..(1282): RXC01088
tgccttgagtctaattctcccgcccgtgcgatgggtttaagctggactgataaaccttttgtgaaccgaattttttaactgatttgaagaagcgagaataatgggactgtggatcgatgcaaccgctggcgttgcaggggatatgttgctgggagcactcattgatgcaggtgcagaactagaaaaaatccaacaggttgtggaagcagtcatccccggtgacgtgctcttgcgcaccgaagaggtagtgcgccaaggccaacgaggcatcaagctgcatgtggacgcacaacatgaacaccatcatcaccgccacttaagcaccattaaagaactgcttgtcaatgctgacatccctgaacaaaccaagcaggatgccttaggcgtttttgaactcatcgctatcgctgaaggaaaagtccacggcatcgagccggagaaaatccacttccatgaggtaggagcttgggattccatcgcagacattgtgggtgtgtgcgaagcgatcaggcagcttaacccaggtttgattgctgcatctccgattgctttaggattcggacgcatcaaggcagctcacggagatattccagtgccagttccagccgtggcagagctggtgaaaggctggcccacccaaaccggagctcttatggagagcaccgaacctgttggtgaattagccaccccaactggtgttgcgttgatccgtcactttgccacccaagatggccctttcccaggtggcatcatcaatgaagttggcattggtgcaggaacaaaagatacagaaggccgtccaaatatagtgcgcgcaattttgttcaacacctctaggagtaacccagatacccgcacactggtgcaattagaagccaatgttgatgatcaagacccacggctgtggccaggagtaatagagatcctctttgccgctggcgcagtagatgcatggctgactccaattttgatgaagaagggccgtcctgcacatagggtgtcagcattggtggatagctccgaggtggaagcagtgaaaaccgcattatttgcagccaccacgacttttgggatcagatcatgggaagtcgaacgagaaggcttggaccgtcgtttcgaacaagtcgaggtggacggacacaccatcaacatcaaaatcggttcccgtgatgatcaagtaatcagtgcacagtccgagtttgaagatattcggtctgcagcggtggccttgggaatttcagagcgggaagttgtggcaagaattccgcaaggcaccaccgagtaacaaccaaaaggtcgactgct

SEQ ID NO: 1094 - protein, 394 aa, Corynebacterium glutamicum
MGLWIDATAGVAGDMLLGALIDAGAELEKIQQVVEAVIPGDVLLRTEEVVRQGQRGIKLHVDAQHEHHHHRHLSTIKELLVNADIPEQTKQDALGVFELIAIAEGKVHGIEPEKIHFHEVGAWDSIADIVGVCEAIRQLNPGLIAASPIALGFGRIKAAHGDIPVPVPAVAELVKGWPTQTGALMESTEPVGELATPTGVALIRHFATQDGPFPGGIINEVGIGAGTKDTEGRPNIVRAILFNTSRSNPDTRTLVQLEANVDDQDPRLWPGVIEILFAAGAVDAWLTPILMKKGRPAHRVSALVDSSEVEAVKTALFAATTTFGIRSWEVEREGLDRRFEQVEVDGHTINIKIGSRDDQVISAQSEFEDIRSAAVALGISEREVVARIPQGTTE

SEQ ID NO: 1095 - DNA, 1419 bp, Corynebacterium glutamicum
  CDS (101)..(1396): RXC02624
acccggtcagatccgacgtcgccggccaaaaccgcaagcacctgcgcaaacgccacagaaggcagctcagcaatcaaagttgctgcgtttccttccaaccgtgctgattccgcatggcgtggcggtgcttttggttattattctcgccgtagcctccctaatgttcaccaattcttcaatggtgaatctttcggcaacgattgcacagctgtggctttccctaaatctcggtgcggtggacggcagtggggaagtgatctcagtactgcccacgcttcccggctttatattcctctgggccatcgccgcgcgcatccaccgcgcagtcaaagatcgtgtcagcatcgccgacttaggcgtcctcgcagcactcgtcctcggcatcccgcttgcgctcaccgccatcgcagcgttcatgcttttcgacgcctccagcgtcctcaacgtcgaggtcccgccaatcacgcgcctcctacgcgtgatgttgttccacctcagcgccctcttcctcggcatggggccacgcctgtggcaggcgttggcgcgccgctacggtgctccagaatggcttatcgacgccatcacccaagctttccgcttcctcatcgcatttggaacagtctccttggtttccgtgctcgtgatgaccgcgatcaaccacagtgcattcaccgcgaccatgcagggttacgacgactccgcctctgttgtggccttgatcgtcctgagcattctgtatctgcccaacatgatgatctttgcgatgggcaatctgatcggctcacccctttacttcggtgacgcctccatcagcgtcttcagcgtgcattccgttccattgccaccgcttcccatcctcgcagctctccccagcgaagccctctcatgggcagtggccttactggtcatccctgcaattattgccacctgggtctgcgtgagaaaccccatgcgccttgccgtgaacacaacagcagcagtcatttcagcactgtgtttcctcgtcctggcagttttcgccggcggaaccttgggcgtatacaactacgtcggactcaacctcctggcgtcagttggcctagttttcgtctatttcgccctcgttggactcctcatcgccggaatcgacaagctgcgcaaccctgtagaagttaagtctgttaaggctgtggctgttgtggagcccgagcctgaagaagttgaagaggacgaagaggagcatgttgaagaagaagtagatgaggaggaagaggaagttgaggaaggggtagaagaggtcgaagaagacgacgcagaggatcctgaagagaatcctgaagaggaagaatccgacgaagaaattgagacagaaactgaggctgaagaaaccaatgatggttccgaggccgaagaccgttaacatatctgttgtgaattctg

SEQ ID NO: 1096 - protein, 432 aa, Corynebacterium glutamicum
VLIPHGVAVLLVIILAVASLMFTNSSMVNLSATIAQLWLSLNLGAVDGSGEVISVLPTLPGFIFLWAIAARIHRAVKDRVSIADLGVLAALVLGIPLALTAIAAFMLFDASSVLNVEVPPITRLLRVMLFHLSALFLGMGPRLWQALARRYGAPEWLIDAITQAFRFLIAFGTVSLVSVLVMTAINHSAFTATMQGYDDSASVVALIVLSILYLPNMMIFAMGNLIGSPLYFGDASISVFSVHSVPLPPLPILAALPSEALSWAVALLVIPAIIATWVCVRNPMRLAVNTTAAVISALCFLVLAVFAGGTLGVYNYVGLNLLASVGLVFVYFALVGLLIAGIDKLRNPVEVKSVKAVAVVEPEPEEVEEDEEEHVEEEVDEEEEEVEEGVEEVEEDDAEDPEENPEEEESDEEIETETEAEETNDGSEAEDR

SEQ ID NO: 1097 - DNA, 603 bp, Corynebacterium glutamicum
  CDS (101)..(580): RXC02665
caaggcgacccaatggcgtttaaagtaacaacccccattgatatgatgctggcacaacgcatcaccgacgaagccgaacccacaatatttgaggtaccaggtgactaacccaatcatcccccgcgtaggaatcgccacagacgcccaccaaatcgaagcgggaaaaccctgctggatcgcctgcctcctctttgaaggcgtcgacggctgcgaaggccactccgacggtgatgttgtagctcatgcaattgtggatgctctcctttctgcctctggtctgggggatttgggctctttcgttggtgtggggagacctgaatacgatggtgtttctggtacacagttgttgaaggaagttcgggagctgctttcggcacacgggtacgtcattggaaatgtcgccgcccaactggttggccaaacccccaaatttggaccccgccgcgaagaagcacaacaagtcatctccgaaatcatcggcgcaccatgctcactgtctgccaccaccactgatcacatgggattcactggtcgcagcgagggtcgtgcatcggtagcaacggcagtggtgtggaaggcttaagttttctgtagggattgggc

SEQ ID NO: 1098 - protein, 160 aa, Corynebacterium glutamicum
VTNPIIPRVGIATDAHQIEAGKPCWIACLLFEGVDGCEGHSDGDVVAHAIVDALLSASGLGDLGSFVGVGRPEYDGVSGTQLLKEVRELLSAHGYVIGNVAAQLVGQTPKFGPRREEAQQVISEIIGAPCSLSATTTDHMGFTGRSEGRASVATAVVWKA

SEQ ID NO: 1099 - DNA, 1689 bp, Corynebacterium glutamicum
  CDS (101)..(1666): RXC02770
tcgccggggcaaaaaccgtataattacagtcctattacgattcggggaaaggctgggtacttcacacatgttgtttcggaagtcacgcagcgcggtaatcatgttggttgcagcgttagtgatgacaagctgtggtgatggggaaccggaaccaaccagccaccaaacaagccttttcggctacgcagttaactcttcgctggctacaaccaacgcggcgtcgctgttgggagtggctaatgatgctggtcttttggctgccagagtgtatccgggtgtgtatgttcagggtccttctgggcagatgattcccaacactgatcttgcttccacgcaggtattgccgggtattaaccgccaggtgatttacactatcaatgaagatgccacctactcagatggtcagcctgtggtgtgtgatgattttctgctctctgcgacagctgggcagatgccggaactgttccagtcccatgtgccattgacctcgcagattgagcgagtggactgtgtatctggttctaaagtagccaccgtggtgttcaaggaagacctcggtgagcgttggcgttatctttttgagcagggcgatttgttgccagcccatgccgttgcttccaaagcaggtatgaccttggaggagcttaatcaggcgttgaaggataaggatcctgaagcgttgactgaacctgctcgtgtgtggagcgaaggtttccagctgtcccagtttgatccagagctgcagacggcttttggcccgtacaaggtggattctgtgggtgaattcggcgaagtcaagctggtacgcaatgagttttacagtggcgaccaggcggttgaagcagaaatcacgatgtggcctaaaggctcggatctcagcgccattgcggataatggaaaccttcagatcgcacatgttgtggcgtgggagagcgagccgtgggtaaatcgcgatgacccattgaatccttatgacattaaggaagaggtcggtgttttgactgagcagctcaccttggccagtgccggtgtgttttacgctgcggaggcccggcaggcgtttgcggcctgcgttgaccaggaagcggtggctgcggcgtcgtcaagcatctctggaatcgatgtgcctgccgtaggtgtgcactcggtgcgtcaccaaaatccggtcgtgcaccaaatcggtgatctgccagcacagcacatggcggtggatattaatgccgcatcagcgttggcgggtcaatccatccgcattggctacgacggacccgatgagcgcaaggctgcaatggtggaggcgattcgccaaagttgtgagcctgccggtatcaccgttatcgatgcgtcgcaggaggctgttagtcttaatgatctcagtcgaaccgaagtcagtgaatggggctatgagcagtacttcgaagggacacttgacgctgttctgcgtacagtggatccacatcgggagtatgaaaatgccaataccattggaactgatgcggagtcgacgaggcgcactgaagaacaattgtgggctgaagtcccatcaattccactagcagcgcaaccccgagtgtttgtgatagatcgcacagtcggtaacgttgttgttaatacagacctagccggtatcggatggaacatggaccgttggtccagaagtgaggaataagtagtgagcgaacaagctct

SEQ ID NO: 1100 - protein, 522 aa, Corynebacterium glutamicum
MLVAALVMTSCGDGEPEPTSHQTSLFGYAVNSSLATTNAASLLGVANDAGLLAARVYPGVYVQGPSGQMIPNTDLASTQVLPGINRQVIYTINEDATYSDGQPVVCDDFLLSATAGQMPELFQSHVPLTSQIERVDCVSGSKVATVVFKEDLGERWRYLFEQGDLLPAHAVASKAGMTLEELNQALKDKDPEALTEPARVWSEGFQLSQFDPELQTAFGPYKVDSVGEFGEVKLVRNEFYSGDQAVEAEITMWPKGSDLSAIADNGNLQIAHVVAWESEPWVNRDDPLNPYDIKEEVGVLTEQLTLASAGVFYAAEARQAFAACVDQEAVAAASSSISGIDVPAVGVHSVRHQNPVVHQIGDLPAQHMAVDINAASALAGQSIRIGYDGPDERKAAMVEAIRQSCEPAGITVIDASQEAVSLNDLSRTEVSEWGYEQYFEGTLDAVLRTVDPHREYENANTIGTDAESTRRTEEQLWAEVPSIPLAAQPRVFVIDRTVGNVVVNTDLAGIGWNMDRWSRSEE

SEQ ID NO: 1101 - DNA, 408 bp, Corynebacterium glutamicum; identical to SEQ ID NO: 237
  CDS (101)..(385): RXC02238

SEQ ID NO: 1102 - protein, 95 aa, Corynebacterium glutamicum; identical to SEQ ID NO: 238

SEQ ID NO: 1103 - DNA, 1298 bp, Corynebacterium glutamicum
  CDS (1)..(1275): RXC01946
atccgcaagtactccaggctcgaggaacaattccagtcgctcggcggctacgaagctgacgccgaagcagcccagatctgcgacaacctcggcctcgaggcacgcatcctcgaccagcagcttaaaaccctgtccggcggccagcgccgccgcgtcgagttggcgcagatcctcttcgccgccaccaacggctccggcaaatcaaaaaccacattgcttctcgacgagcccaccaaccacttggacgcagactcgatcacctggctccgtgacttcctggcgaagcacgaaggtggactgatcatgatttcgcacgacgtcgaactgcttggcgccgtatgtaacaagatttggtacctcgacgcagtacgcagcgaagccgatgtctacaacatgggctttagcaaatacgtcgatgcacgtgcactcgatgaagcacgccgacgccgtgagcgcgcaaacgccgaaaagaaggccggagccctcaaggaccaggctgcacgcctcggcgcgaaagcaaccaaggctgccgcagctaagcagatgatcgcccgtgcggaacgaatgatcgacaacctcgacgaaatccgcgtagctgaccgcgccgccaacatcgttttcccagaaccagcaccctgtggaaaaaccccactcaacgccaagggcctgaccaagatgtacggctccctcgaagtcttcgccggcgtcgacctagccatcgacaaaggctcccgcgtagtcgtcctcggattcaacggtgcaggtaaaaccaccctgctcaaactcctcgccggtgtggaacgcaccgacggcgaaggcggcatcgtcaccggatacggcctcaaaatcggctacttcgcccaggaacacgacaccatcgaccccgacaaatccgtctggcaaaacaccatcgaagcctgcgccgacgccgaccaacaaagcctccgcagcctcctcggatccttcatgttctccggcgaacaactcgaccaaccagcaggaacactctccggcggtgaaaaaacccgcctcgcactggccaccctcgtgtcctcccgcgcaaacgtcctgcttctcgacgagcccaccaacaaccttgacccgatctcccgcgaacaggtcctcgacgcactgcgcacctacaccggcgcagtcgtcctggttacccacgacccgggtgcagtcaaggcccttgagccagaacgcgtcatcgtgcttcctgatggcaccgaggatctttggaatgatcagtacatggaaatcgtggaattggcgtaggttctaaggctgtttatgct

SEQ ID NO: 1104 - protein, 425 aa, Corynebacterium glutamicum
IRKYSRLEEQFQSLGGYEADAEAAQICDNLGLEARILDQQLKTLSGGQRRRVELAQILFAATNGSGKSKTTLLLDEPTNHLDADSITWLRDFLAKHEGGLIMISHDVELLGAVCNKIWYLDAVRSEADVYNMGFSKYVDARALDEARRRRERANAEKKAGALKDQAARLGAKATKAAAAKQMIARAERMIDNLDEIRVADRAANIVFPEPAPCGKTPLNAKGLTKMYGSLEVFAGVDLAIDKGSRVVVLGFNGAGKTTLLKLLAGVERTDGEGGIVTGYGLKIGYFAQEHDTIDPDKSVWQNTIEACADADQQSLRSLLGSFMFSGEQLDQPAGTLSGGEKTRLALATLVSSRANVLLLDEPTNNLDPISREQVLDALRTYTGAVVLVTHDPGAVKALEPERVIVLPDGTEDLWNDQYMEIVELA

SEQ ID NO: 1105 - DNA, 613 bp, Corynebacterium glutamicum; identical to SEQ ID NO: 1015
  CDS (101)..(613): RXN03171

SEQ ID NO: 1106 - protein, 171 aa, Corynebacterium glutamicum; identical to SEQ ID NO: 1016

SEQ ID NO: 1107 - DNA, 613 bp, Corynebacterium glutamicum; identical to SEQ ID NO: 1015
  CDS (101)..(613): FRXA02857

SEQ ID NO: 1108 - protein, 171 aa, Corynebacterium glutamicum; identical to SEQ ID NO: 1016

SEQ ID NO: 1109 - DNA, 424 bp, Corynebacterium glutamicum; identical to SEQ ID NO: 1003
  CDS (101)..(424): RXN00450

SEQ ID NO: 1110 - protein, 108 aa, Corynebacterium glutamicum; identical to SEQ ID NO: 1004

SEQ ID NO: 1111 - DNA, 418 bp, Corynebacterium glutamicum; identical to SEQ ID NO: 1005
  CDS (101)..(418): FRXA00450

SEQ ID NO: 1112 - protein, 106 aa, Corynebacterium glutamicum; identical to SEQ ID NO: 1006

SEQ ID NO: 1113 - DNA, 615 bp, Corynebacterium glutamicum
  CDS (101)..(592): RXA00465
tccccaacgcgcaccgaacttagccggatcgcagacttcacctggatgtccaccgcagcccaagcgctaccagcgttgatgcgaggtttgagcgcctaacatgactgaagatgacttagatctgctgcaccgcacagtagaactagccacccaggcactcaagcagggaaacagtccttatggatccctgctggttgatcccttcggcgcggtcgtttttgaagaccacaaccgagatgccgatggggatctgaccaagcacccggaattcgccatcgccaaatatgcgatcgaaaattacagtgcatcagaacgtgctgcgtgcactgtttatacctcgacggaacattgcgcgatgtgcgccggtgcccatgcgtgggctggactgggcaaaatttactgcgccaccacaggtgggcaaacagccgcttggtacgcaaagtggggtgcagaatctgggcctttgaacccgatttcagcggacaaaattagcccgaacatatccatcgaaggacctgcttccagatttgaggaagtcctgtatgaactgcatcgatggttttatttagggcagtctccgaataaggctctttagcgctgggcatgtgactttaa

SEQ ID NO: 1114 - protein, 164 aa, Corynebacterium glutamicum
MTEDDLDLLHRTVELATQALKQGNSPYGSLLVDPFGAVVFEDHNRDADGDLTKHPEFAIAKYAIENYSASERAACTVYTSTEHCAMCAGAHAWAGLGKIYCATTGGQTAAWYAKWGAESGPLNPISADKISPNISIEGPASRFEEVLYELHRWFYLGQSPNKAL

SEQ ID NO: 1115 - DNA, 1083 bp, Corynebacterium glutamicum
  CDS (101)..(1060): RXA00717
aagcatcagttaaagccccgactattaaaatctcctaaaataggctagaattcacgggattcaatttcatacgttttctctcaagattaaggacacttacgtgaccccacccgctcgccgagatggcacaccggacaagaagcagagcaatcgctctggcggataccggtcttcagttcgtggctacaagccaggatcatcccgcccaaacacacgccagcagcctcagaagaaggatgagattcttctctccaacgctaagcctgccaagaagcaaaacgtaaaatccgacgacgattggtcgatgggtttcttaaaccgcaatgactctgacggagttcgcctgcagaaggtgcttgcccaagcaggtgtggcatcacgtcgacacgcagaaatcctgattgatcagggccgtgtggaggtcaacgatcgtatcgtgaccacccagggcgtgcgcgtggatccaaacaacgatgtcatccgtgttgacggcgtccgcatccacatcaacgaggacctcgagtacttcgtgctcaacaagcctcgtggcatgcactccaccatgagcgatgaacttggtcgcccatgcgtgggtgatctggtcagtgagaagactgcatctggacagcgtctgttccacgtcggtcgcctcgacgcggacaccgaaggtttgctgctgctcaccaacgatggtgagttggctaaccgcctcatgcaccctaagtacgaagtgtccaagacttaccttgctaccgttcgcggtgaagcaaccaataagctagtcagcgctcttcgtgatggcgtggagttggaagatggccctgccaaggctgactttgcgcagattatcgacgtattccagggcaagtccttgttgcgcatcgaaatccacgaaggccgcaagcacattgtgcgacgcctcttcgatgagctcggtttcccagtcgagcgcctcgtgcgcaccaagctgcacaccgttcagcttggtgatcagaagccaggttcccttcgtgcactgaactcctctgagctgaccagcttatacaaggtggtccaactgtgacggaaatttccaacatgcct

SEQ ID NO: 1116 - protein, 320 aa, Corynebacterium glutamicum
VTPPARRDGTPDKKQSNRSGGYRSSVRGYKPGSSRPNTRQQPQKKDEILLSNAKPAKKQNVKSDDDWSMGFLNRNDSDGVRLQKVLAQAGVASRRHAEILIDQGRVEVNDRIVTTQGVRVDPNNDVIRVDGVRIHINEDLEYFVLNKPRGMHSTMSDELGRPCVGDLVSEKTASGQRLFHVGRLDADTEGLLLLTNDGELANRLMHPKYEVSKTYLATVRGEATNKLVSALRDGVELEDGPAKADFAQIIDVFQGKSLLRIEIHEGRKHIVRRLFDELGFPVERLVRTKLHTVQLGDQKPGSLRALNSSELTSLYKVVQL

SEQ ID NO: 1117 - DNA, 978 bp, Corynebacterium glutamicum
  CDS (101)..(955): RXA01894
agaattttttcgaaaatgctggcaccatcaacagtgacattgttagaaacttcaaggagaacccatgaatgaaccggagcaacatcaccggtccatgaggatgcccaaacccaaaaataatgcgggtcgagatctcaaagctgccattgctgtggggatcggactgggggtcctggttcttttggggattgtcctaagcccatggggttggtacatcctcgttgcaggttttatggctgcagcaacatgggaagttggtagcagacttaaagaaggcggctatcatttgccactgccgattatgatcatcggcggtcaggcaatcatctggctgtcatggccatttggcacgatgggcattttggcgtcttttgtggccactgtgttggtgctgatgtatttccgaattttctacaatggcacggaaaaagaagcccgcaactatttgagggacacctctgtgggcatcttcgtgctcacctggattccattgttcggaagcttcgctgcgatgctgtcgctgatgcaaaacaattccatcccgggtacatatttcattttgacgttcatgctgtgtgtgatcgcatcggatgtgggcgggtatatcgcgggtgtgttctttggatcgcacccaatggcgccgttggtgagtccgaagaagtcttgggaaggctttgccggctccattgtcttaggatcggtcactggtgcactcagtgttcacttcctgctcgatcaccactggtggatgggtgtgatcttgggttgtgccctagttgtgtgcgccacgttgggtgacttggttgagtcgcagttcaaacgcgatttgggcatcaaggatatgtcgaaccttcttccaggccacggcggattgatggaccgtttggatggcatgctcccggccgcgatggtgacgtggttgatcctgagtgtgatcagcagctcgtatccgtcgtaaagcttgggccagctttaagt

SEQ ID NO: 1118 - protein, 285 aa, Corynebacterium glutamicum
MPKPKNNAGRDLKAAIAVGIGLGVLVLLGIVLSPWGWYILVAGFMAAATWEVGSRLKEGGYHLPLPIMIIGGQAIIWLSWPFGTMGILASFVATVLVLMYFRIFYNGTEKEARNYLRDTSVGIFVLTWIPLFGSFAAMLSLMQNNSIPGTYFILTFMLCVIASDVGGYIAGVFFGSHPMAPLVSPKKSWEGFAGSIVLGSVTGALSVHFLLDHHWWMGVILGCALVVCATLGDLVESQFKRDLGIKDMSNLLPGHGGLMDRLDGMLPAAMVTWLILSVISSSYPS

SEQ ID NO: 1119 - DNA, 879 bp, Corynebacterium glutamicum; identical to SEQ ID NO: 133
  CDS (101)..(856): RXA02536

SEQ ID NO: 1120 - protein, 252 aa, Corynebacterium glutamicum; identical to SEQ ID NO: 134

SEQ ID NO: 1121 - DNA, 1528 bp, Corynebacterium glutamicum; identical to SEQ ID NO: 539
  CDS (101)..(1528): RXN01209

SEQ ID NO: 1122 - protein, 476 aa, Corynebacterium glutamicum; identical to SEQ ID NO: 540

SEQ ID NO: 1123 - DNA, 1528 bp, Corynebacterium glutamicum; identical to SEQ ID NO: 539
  CDS (101)..(1528): FRXA01209

SEQ ID NO: 1124 - protein, 476 aa, Corynebacterium glutamicum; identical to SEQ ID NO: 540

SEQ ID NO: 1125 - DNA, 795 bp, Corynebacterium glutamicum; identical to SEQ ID NO: 545
  CDS (101)..(772): RXN01617

SEQ ID NO: 1126 - protein, 224 aa, Corynebacterium glutamicum; identical to SEQ ID NO: 546

SEQ ID NO: 1127 - DNA, 638 bp, Corynebacterium glutamicum; identical to SEQ ID NO: 547
  CDS (1)..(615): FRXA01617

SEQ ID NO: 1128 - protein, 205 aa, Corynebacterium glutamicum; identical to SEQ ID NO: 548

SEQ ID NO: 1129 - DNA, 792 bp, Corynebacterium glutamicum
  CDS (101)..(769): RXC01600
tgagtacaaatctcgtccaacccatgctcatccactgttttacggcctggtgaagaccgctttggagctgcgtgtccacccttagatctacaatgtgatcatggtttcgaagatgcacattcccggtacccatgagttcacggtgacagatactgaactgttgttagagtccccaattttgggcgttcgtcgagattcattgatcatgccgggtggttccactgcccgccgtgaagtggttgaacactttggggcggtcgcagtggttgcctttgatggtgaaaacattgcgatggtcaagcagtaccgtcgcagcgtgggggattccttgtgggagctgcctgcaggtttgttggatattgctgatgaggatgaactcacgggcgcgcagcgcgagctcatggaggaggctggtttggaggccagtgagtggtccgtgctcactgatttgattacctcgcctggtttctgcgatgaagcggtgcgtgtctttctagcccgaggcctcacaaaggttgagcgcccgaaggttatgggcgatgaagaagcggacatgattaaccagtgggttccgctacatgaggcagtgggaatggtgtttagtggccagttggttaactccattgccattgcgggtgtcatggctgctgatgctgtgattgcgggtcgtgcgtctgcgcgtgccgtcaccgcgccgtttacctatcgccctacggcgttggcgcagcgtcgaaaagcgcacggcattgttcctgacatgaaaaaactatgaaggctcgcgttttagcgaaa

SEQ ID NO: 1130 - protein, 223 aa, Corynebacterium glutamicum
MVSKMHIPGTHEFTVTDTELLLESPILGVRRDSLIMPGGSTARREVVEHFGAVAVVAFDGENIAMVKQYRRSVGDSLWELPAGLLDIADEDELTGAQRELMEEAGLEASEWSVLTDLITSPGFCDEAVRVFLARGLTKVERPKVMGDEEADMINQWVPLHEAVGMVFSGQLVNSIAIAGVMAADAVIAGRASARAVTAPFTYRPTALAQRRKAHGIVPDMKKL

SEQ ID NO: 1131 - DNA, 726 bp, Corynebacterium glutamicum
  CDS (101)..(703): RXC01622
aaggcgtgggcgtttttgaaggagcttcgtttggagcgcggtcctttggatcgtgaagttgccatcgcagagctgaagagctggtgggaaggagaaaacaatgagtgatttttatgccgacaggttgtttaacgcgatggagcgcaatgaggtagctccaggcatgttgttggtggctgcgcccgatatggcgtcggaggattttgagcgcagcatcgtgttgatcatcgagcattctcctgccaccacttttggtgtgaacatttcttcacgttccgatgttgctgtggccaatgtgttgcccgagtgggtggacctcacctcgaagccacaggcactgtacatcggtgggccgttgagccagcaggctgtggttggtttgggcgtgaccaagccgggcgtggatattgaaaattccaccagcttcaacaagctcgccaaccgcctggtgcacgtggatctgcgttctgcacctgaagatgtggctgatgatcttgagggcatgcgcttttttgcgggctacgcggagtgggctccgggccagctcaacgaggaaattgagcagggtgattggttcgtcacacctgcgttgccgtcggacattatcgcgccgggccgcgtcgatatttggggcgacgtgatgcgtcgacaagcaatgcctttgccgttgtattccacgtttccgtcggacccttcagataattagatgagttccgaaaatttaaa

SEQ ID NO: 1132 - protein, 201 aa, Corynebacterium glutamicum
MSDFYADRLFNAMERNEVAPGMLLVAAPDMASEDFERSIVLIIEHSPATTFGVNISSRSDVAVANVLPEWVDLTSKPQALYIGGPLSQQAVVGLGVTKPGVDIENSTSFNKLANRLVHVDLRSAPEDVADDLEGMRFFAGYAEWAPGQLNEEIEQGDWFVTPALPSDIIAPGRVDIWGDVMRRQAMPLPLYSTFPSDPSDN

SEQ ID NO: 1133 - DNA, 1827 bp, Corynebacterium glutamicum; identical to SEQ ID NO: 239
  CDS (101)..(1804): RXC00128

SEQ ID NO: 1134 - protein, 568 aa, Corynebacterium glutamicum; identical to SEQ ID NO: 240

SEQ ID NO: 1135 - DNA, 555 bp, Corynebacterium glutamicum
  CDS (101)..(532): RXC01709
gcaagtggaaccacgatgggaacggtaactgctgccgctgcggtattactcgtagtttcagaaattaggtgtcgatgcagcaatacggaactttgccaatgtgtttgaacaagctctcgggctcaccacccttgcacaaacagctggagcgggcgcagcggggggcttgggtttcatggcaatggcgttgttgtctgcagggatgcgctccggcgtggacatgattcttaatgaaaccgggggtgaaaagatgcttgcacaggcagatttagtcatcactggagaaggacgcattgatgcacagaccctcagcgggaaagctcctactggaatcgccaaacgggcacgtgcgaaaggaattccagtactggcggtttgtgggcagagcctattgggtccagcaatctcaaatgagctatttgaagacatctacagctttaccgatttcgaatctgacatcaatgaatgcattcgaaacccgctcccaattttggaaggtatcggttttaacatcgccaaacatcatctgagttagcgatatttcagcaaaccgat

SEQ ID NO: 1136 - protein, 144 aa, Corynebacterium glutamicum
VFEQALGLTTLAQTAGAGAAGGLGFMAMALLSAGMRSGVDMILNETGGEKMLAQADLVITGEGRIDAQTLSGKAPTGIAKRARAKGIPVLAVCGQSLLGPAISNELFEDIYSFTDFESDINECIRNPLPILEGIGFNIAKHHLS

SEQ ID NO: 1137 - DNA, 898 bp, Corynebacterium glutamicum
  CDS (101)..(898): RXC02207
gaatcggtgactttgccaacaccaatcacacaagcccttgatgatgtctccctgtgacttggtccaattacattcactggtaatctgaaaccttgtgaatatgcgccgtcgatcccgtgtgtcccgtttgcttcccgccacagctttgctggcctcaactgcacttcttttaagtgcatgtacgcaaggggtaacggactccccggatatgggcaaggcaactcccgctgtctcccccgcagcaagcaacccggatggccaagtaattgagttcggcaacatcactgacatggaagtcactgatggtgacatcctcggtgtacgcaccgaagacgcactcgctattggtacagtctccgacttcgaagcgggtagccaggtggaactggacgtcgataagcaatgcggcgacctgaccgcaaccggcggcactttcgtgctcccctgcgccgatggcgtttatttgattgatgccaaggacccggatctggatgagttgcgtgcaactgacaagccagtcacggtggcagccttgaccagcgatgatcagcttctggtgggcaatggtgaagatgaagaactcaccatctaccgcgagggcgaagagccagaaaccttcaccgtcgcgggtcccaatacccagctcatcgccgttcctgtcattgatcgccacgacgccgttgtgcgcacctggaacgaaaacaccacgattcaagatgtggactaccccaacgaccgtgaaggcgcgacccttcgcgtgggactcggcgttggtcaaatggctggtggcgaagacggcctgctggtggtctctgatgaaatgggtggccaaattgccatctacaacgctgatgatgtcatccgacttcaaaatgaccgcccccaccgacgaggaacc

SEQ ID NO: 1138 - protein, 266 aa, Corynebacterium glutamicum
MRRRSRVSRLLPATALLASTALLLSACTQGVTDSPDMGKATPAVSPAASNPDGQVIEFGNITDMEVTDGDILGVRTEDALAIGTVSDFEAGSQVELDVDKQCGDLTATGGTFVLPCADGVYLIDAKDPDLDELRATDKPVTVAALTSDDQLLVGNGEDEELTIYREGEEPETFTVAGPNTQLIAVPVIDRHDAVVRTWNENTTIQDVDYPNDREGATLRVGLGVGQMAGGEDGLLVVSDEMGGQIAIYNADDVIRLQNDRPHRRGT

SEQ ID NO: 1139 - DNA, 891 bp, Corynebacterium glutamicum
  CDS (101)..(868): RXA00347
tcggccagcaatccgcttggtgtcctggatcgcgccgacatcttaaggtgccagggctttaaagtgccaggggttctgtgggatccgtacactggttcccatgactttgactattgaggaaatcgccaagaccaaaaagcttttggttgtgtccgattttgatggaaccatcgcaggatttagcaaggacgcttacaacgttcctatcaaccagaaatccctcaaggcggtaaaagacctctcccaacaagcagacactgatgttgtcattttgtcgggacgtcacctggagggattgaagacggttcttgatcttggtcagtacgacatcaccatggtgggttcacacggttctgaggattcctcccgcccgcgtaccctcactcctgaagaggtagctcgcctcgccaagattgaagcagatctggaaaagatcgtcgacggcatcgaaggcgcattcgtggagatcaagcctttccaccgcgtgctgcacttcatccgtgtttccgacaaggacaaagtccaaggaatcctcgcccaagcagcacacgtagactcttccggcctgaaggttactaacggcaagagcatcatcgaatactccatcagctccaccaccaagggcacctggctgaaggaatacgttgaccgcaccgagcccactggtgtgattttcctcggcgatgacaccaccgatgagcacggtttcaaagctttagaaaacgatgatcgtgccctaaccgtcaaggttggcgaaggagacactgcagccaaaacccgcgtcgacgatgttgataatgtgggaattttcctagagaaactcgcctaccaccgcatgcagtatgcggaaagcgtgcgattggggatttaagagagcctaaacgcacgaaa

SEQ ID NO: 1140 - protein, 256 aa, Corynebacterium glutamicum
MTLTIEEIAKTKKLLVVSDFDGTIAGFSKDAYNVPINQKSLKAVKDLSQQADTDVVILSGRHLEGLKTVLDLGQYDITMVGSHGSEDSSRPRTLTPEEVARLAKIEADLEKIVDGIEGAFVEIKPFHRVLHFIRVSDKDKVQGILAQAAHVDSSGLKVTNGKSIIEYSISSTTKGTWLKEYVDRTEPTGVIFLGDDTTDEHGFKALENDDRALTVKVGEGDTAAKTRVDDVDNVGIFLEKLAYHRMQYAESVRLGI

SEQ ID NO: 1141 - DNA, 2556 bp, Corynebacterium glutamicum
  CDS (101)..(2533): RXN01239
gcacttgctgcgtaaatctttttcccacgccgggaatgcgtgaacactaagatcgaggacgtaccgcacgattttgcctaacttttaagggtgtttcatcatggcacgtccaatttccgcaacgtacaggcttcaaatgcgaggacctcaagcagatagcgccgggcgttcatttggttttgcgcaggccaaagcccagcttccctatctgaagaagctaggcatcagccacctgtacctctcccctatttttacggccatgccagattccaatcatggctacgatgtcattgatcccaccaccatcaatgaagagctcggtggcatggagggtcttcgagatcttgccgcagctacacacgagttgggcatgggcatcatcattgatattgttcccaaccatttaggtgttgccgttccacatttgaatccttggtggtgggatgttctaaaaaacggcaaagattccgcttttgagttctatttcgatattgactggcacgaagacaacggttctggtggcaagctgggcatgccgattctgggtgctgaaggcgatgaagacaagctggaattcgcggagcttgatggagagaaagtgctcaaatattttgaccacctcttcccaatcgcgcctggtaccgaagaagggacaccgcaagaagtctacaagcgccagcattaccgcctgcagttctggcgcgatggcgtgatcaacttccgtcgcttcttttccgtgaatacgttggctggcatcaggcaagaagatcccttagtgtttgaacatactcatcgtctgctgcgcgaattggtggcggaagacctcattgacggcgtgcgcgtcgatcaccccgacgggctttccgatccttttggatatctgcacagactccgcgacctcattggacctgaccgctggctgatcatcgaaaagatcttgagcgttgatgaaccactcgatccccgcctggccgttgatggcaccactggctacgacgccctccgtgaactcgacggcgtgtttatctcccgagaatctgaggacaaattctccatgctggcgctgacccacagtggatccacctgggatgaacgcgccctcaaatccacggaggaaagcctcaaacgagtcgtcgcccaacaagaactcgcagccgaaatcttaaggctcgcccgcgccatgcgccgcgataacttctccaccgcaggcaccaacgtcaccgaagacaaacttagcgaaaccatcatcgaattagtcgccgccatgcccgtctaccgcgccgactacatctccctctcacgcaccaccgccaccgtcatcgcggagatgtccaaacgcttcccctcccggcgtgacgcactcgacctcatcgcggccgccctacttggcaatggcgaggccaaaatccgcttcgctcaagtctgcggcgccgtcatggctaaaggtgtggaagacaccaccttctaccgcgcatctaggctcgttgcattgcaagaagtcggtggcgcgccggggagattcggcgtctccgctgcagaattccacttgctgcaggaagaacgcagcctgctgtggccacgcaccatgaccaccttgtccacgcatgacaccaaacgtggcgaagatacccgcgcccgcatcatctccctgtctgaagtccccgatatgtactccgagctggtcaatcgtgttttcgcggtgctccccgcgccagacggcgcaacgggcagtttcctcctacaaaacctgctgggcgtatggcccgccgacggcgtgatcaccgatgcgctgcgcgatcgattcagggaatacgccctaaaagctatccgcgaagcatccacaaaaaccacgtgggtggaccccaacgagtccttcgaggctgcggtctgcgattgggtggaagcgcttttcgacggaccctccacctcactaatcaccgaatttgtctcccacatcaaccgtggctctgtgcaaatctccttaggcaggaaactgctgcaaatggtgggcgctggaatccccgacacttaccaaggaactgagtttttagaagactccctggtagatcccgataaccgacgctttgttgattacaccgccagagaacaagtcctggagcgcctgcaaacctgggcttggacgcaggttaattcggtagaagacttggtggataacgccgacatcgccaaaatggccgtggtccataaatccctcgagttgcgtgctgaatttcgtgcaagctttgttggtggagatcatcaggcagtatttggcgaaggtcgcgcagaatcccacatcatgggcatcgcccgcggtacagaccgaaaccacctcaacatcattgctcttgctacccgtcgaccactgatcttggaagaccgtggcggatggtatgacaccaccgtcacgcttcctggtggacaatgggaagacaggctcaccgggcaacgcttcagtggtgttgtcccagccaccgatttgttctcacatctacccgtatctttgttggttttagtacccgatagtgagttttgatccctgcacaggaaagttag

SEQ ID NO: 1142 - protein, 811 aa, Corynebacterium glutamicum
MARPISATYRLQMRGPQADSAGRSFGFAQAKAQLPYLKKLGISHLYLSPIFTAMPDSNHGYDVIDPTTINEELGGMEGLRDLAAATHELGMGIIIDIVPNHLGVAVPHLNPWWWDVLKNGKDSAFEFYFDIDWHEDNGSGGKLGMPILGAEGDEDKLEFAELDGEKVLKYFDHLFPIAPGTEEGTPQEVYKRQHYRLQFWRDGVINFRRFFSVNTLAGIRQEDPLVFEHTHRLLRELVAEDLIDGVRVDHPDGLSDPFGYLHRLRDLIGPDRWLIIEKILSVDEPLDPRLAVDGTTGYDALRELDGVFISRESEDKFSMLALTHSGSTWDERALKSTEESLKRVVAQQELAAEILRLARAMRRDNFSTAGTNVTEDKLSETIIELVAAMPVYRADYISLSRTTATVIAEMSKRFPSRRDALDLIAAALLGNGEAKIRFAQVCGAVMAKGVEDTTFYRASRLVALQEVGGAPGRFGVSAAEFHLLQEERSLLWPRTMTTLSTHDTKRGEDTRARIISLSEVPDMYSELVNRVFAVLPAPDGATGSFLLQNLLGVWPADGVITDALRDRFREYALKAIREASTKTTWVDPNESFEAAVCDWVEALFDGPSTSLITEFVSHINRGSVQISLGRKLLQMVGAGIPDTYQGTEFLEDSLVDPDNRRFVDYTAREQVLERLQTWAWTQVNSVEDLVDNADIAKMAVVHKSLELRAEFRASFVGGDHQAVFGEGRAESHIMGIARGTDRNHLNIIALATRRPLILEDRGGWYDTTVTLPGGQWEDRLTGQRFSGVVPATDLFSHLPVSLLVLVPDSEF

SEQ ID NO: 1143 - DNA, 2556 bp, Corynebacterium glutamicum
  CDS (101)..(2533): FRXA01239
gcacttgctgcgtaaatctttttcccacgccgggaatgcgtgaacactaagatcgaggacgtaccgcacgattttgcctaacttttaagggtgtttcatcatggcacgtccaatttccgcaacgtacaggcttcaaatgcgaggacctcaagcagatagcgccgggcgttcatttggttttgcgcaggccaaagcccagcttccctatctgaagaagctaggcatcagccacctgtacctctcccctatttttacggccatgccagattccaatcatggctacgatgtcattgatcccaccaccatcaatgaagagctcggtggcatggagggtcttcgagatcttgccgcagctacacacgagttgggcatgggcatcatcattgatattgttcccaaccatttaggtgttgccgttccacatttgaatccttggtggtgggatgttctaaaaaacggcaaagattccgcttttgagttctatttcgatattgactggcacgaagacaacggttctggtggcaagctgggcatgccgattctgggtgctgaaggcgatgaagacaagctggaattcgcggagcttgatggagagaaagtgctcaaatattttgaccacctcttcccaatcgcgcctggtaccgaagaagggacaccgcaagaagtctacaagcgccagcattaccgcctgcagttctggcgcgatggcgtgatcaacttccgtcgcttcttttccgtgaatacgttggctggcatcaggcaagaagatcccttagtgtttgaacatactcatcgtctgctgcgcgaattggtggcggaagacctcattgacggcgtgcgcgtcgatcaccccgacgggctttccgatccttttggatatctgcacagactccgcgacctcattggacctgaccgctggctgatcatcgaaaagatcttgagcgttgatgaaccactcgatccccgcctggccgttgatggcaccactggctacgacgccctccgtgaactcgacggcgtgtttatctcccgagaatctgaggacaaattctccatgctggcgctgacccacagtggatccacctgggatgaacgcgccctcaaatccacggaggaaagcctcaaacgagtcgtcgcccaacaagaactcgcagccgaaatcttaaggctcgcccgcgccatgcgccgcgataacttctccaccgcaggcaccaacgtcaccgaagacaaacttagcgaaaccatcatcgaattagtcgccgccatgcccgtctaccgcgccgactacatctccctctcacgcaccaccgccaccgtcatcgcggagatgtccaaacgcttcccctcccggcgtgacgcactcgacctcatcgcggccgccctacttggcaatggcgaggccaaaatccgcttcgctcaagtctgcggcgccgtcatggctaaaggtgtggaagacaccaccttctaccgcgcatctaggctcgttgcattgcaagaagtcggtggcgcgccggggagattcggcgtctccgctgcagaattccacttgctgcaggaagaacgcagcctgctgtggccacgcaccatgaccaccttgtccacgcatgacaccaaacgtggcgaagatacccgcgcccgcatcatctccctgtctgaagtccccgatatgtactccgagctggtcaatcgtgttttcgcggtgctccccgcgccagacggcgcaacgggcagtttcctcctacaaaacctgctgggcgtatggcccgccgacggcgtgatcaccgatgcgctgcgcgatcgattcagggaatacgccctaaaagctatccgcgaagcatccacaaaaaccacgtgggtggaccccaacgagtccttcgaggctgcggtctgcgattgggtggaagcgcttttcgacggaccctccacctcactaatcaccgaatttgtctcccacatcaaccgtggctctgtgcaaatctccttaggcaggaaactgctgcaaatggtgggcgctggaatccccgacacttaccaaggaactgagtttttagaagactccctggtagatcccgataaccgacgctttgttgattacaccgccagagaacaagtcctggagcgcctgcaaacctgggattggacgcaggttaattcggtagaagacttggtggataacgccgacatcgccaaaatggccgtggtccataaatccctcgagttgcgtgctgaatttcgtgcaagctttgttggtggagatcatcaggcagtatttggcgaaggtcgcgcagaatcccacatcatgggcatcgcccgcggtacagaccgaaaccacctcaacatcattgctcttgctacccgtcgaccactgatcttggaagaccgtggcggatggtatgacaccaccgtcacgcttcctggtggacaatgggaagacaggctcaccgggcaacgcttcagtggtgttgtcccagccaccgatttgttctcacatctacccgtatctttgttggttttagtacccgatagtgagttttgatccctgcacaggaaagttag

SEQ ID NO: 1144 - protein, 811 aa, Corynebacterium glutamicum
MARPISATYRLQMRGPQADSAGRSFGFAQAKAQLPYLKKLGISHLYLSPIFTAMPDSNHGYDVIDPTTINEELGGMEGLRDLAAATHELGMGIIIDIVPNHLGVAVPHLNPWWWDVLKNGKDSAFEFYFDIDWHEDNGSGGKLGMPILGAEGDEDKLEFAELDGEKVLKYFDHLFPIAPGTEEGTPQEVYKRQHYRLQFWRDGVINFRRFFSVNTLAGIRQEDPLVFEHTHRLLRELVAEDLIDGVRVDHPDGLSDPFGYLHRLRDLIGPDRWLIIEKILSVDEPLDPRLAVDGTTGYDALRELDGVFISRESEDKFSMLALTHSGSTWDERALKSTEESLKRVVAQQELAAEILRLARAMRRDNFSTAGTNVTEDKLSETIIELVAAMPVYRADYISLSRTTATVIAEMSKRFPSRRDALDLIAAALLGNGEAKIRFAQVCGAVMAKGVEDTTFYRASRLVALQEVGGAPGRFGVSAAEFHLLQEERSLLWPRTMTTLSTHDTKRGEDTRARIISLSEVPDMYSELVNRVFAVLPAPDGATGSFLLQNLLGVWPADGVITDALRDRFREYALKAIREASTKTTWVDPNESFEAAVCDWVEALFDGPSTSLITEFVSHINRGSVQISLGRKLLQMVGAGIPDTYQGTEFLEDSLVDPDNRRFVDYTAREQVLERLQTWDWTQVNSVEDLVDNADIAKMAVVHKSLELRAEFRASFVGGDHQAVFGEGRAESHIMGIARGTDRNHLNIIALATRRPLILEDRGGWYDTTVTLPGGQWEDRLTGQRFSGVVPATDLFSHLPVSLLVLVPDSEF

SEQ ID NO: 1145 - DNA, 1953 bp, Corynebacterium glutamicum
  CDS (101)..(1930): RXA02645
gatacagctccttgatggagtgaataaattcgcgagcctgctcctgatcttgcacacgcgtgatataggtcagaaatcgcgagcgcttgatctctagttcatgctcaaagacttgaccggcctgagggagttggtattgcgtgagatgtgccatagcatctcacatcttagctcgccaaccggcagcattttcactagcctggtggccatgttgacctcgcaaagcttttcagtgtgggctccacttccccacgatgtacatctgatcctcaacggcgaaaccctccccatgcacaaaacggagggcagctggtggcgcgccgagatcgcgcccaaggccggcgatcgttacggtttttcgcttttcgacggctcctcctggtcaaaaaccctccccgatccccgctccacatctcaaccagacggggttcatggtttaagtgaagtctccgatgattcctatctgtggggtgaccagcagtggactggccgaattctccctggctcggtgttatatgagctgcatgtgggcacctttagtgaagatggaacgtttgagggagtcgtcgacaagcttccttatctgcgcgacctcggcgtgaccgccatcgaacttttacccgtgcagccctttggcggcaaccgcaattggggctacgacggggtgctgtggcacgccgtccatgcaggctacggcggtccggcgggcttgaaaaagcttatcgacgcctcccaccaggccggcatcgccgtctacttagacgtcgtgtacaaccacttcggccccgacggcaactacaacgggcaatttggcccctacacctctggcggcagcaccggctggggcgacgtggtcaacatcaacggccatgattcagatgaagtccgcaattatattctcgacgccgcacgccagtggttcgaagattttcacgttgatgggctccgcctcgatgcggtgcattctctcgatgatcgcggcgcctattccctacttgcgcagctgaccatggtggccgaggatgtctccgcacaaacaggcatcccacgctcattgattgcagaatctgaactcaatgaccccaagttcgttacctcccgcgaggccggcggttttggcctggatgcacagtgggttgacgatatccaccacgccctccatgccctcgtttctggcgaacgcaatggttattacagcgatttcggatctgtcgacacattagccaaaaccctgcgtgaagtatttgaacacaccggaaactactccacgtaccgcggacgcaaccacggccgccctgtgcaccccgatatcacccctgcctcgcgctttgtcacctacaccaccacccatgatcagaccggcaaccgcgcaatcggcgaccgtccttccacgactctcaccccggaacagcaggtgttgaaggcagccattatctacagctcgccgtataccccgatgttgtttatgggtgaagaattcggagccaccaccccattcgccttcttttgctcccacaccgaccccgagctcaaccggctaacctccgagggccgcaaacgggaattcgcacgccttggctggaacgccgacgacatcccctcccccgagctggaatccaccttcacctcctccaaactcgattgggagttcactgcggagcagcgccgcatcaacgacgcttacaagcagctgttgcacctgcggcacaccttgggcttctcccaaccaaacttgctcacactcgaggttgagcacggcgagaactggctatcgatggccaatggtcgcggccgaattctggcgaatttctccgacgacaccatcaccgtcccgcttggcggcgagctgatttacagcttcacttcccccaccgtcaccgacacctccacaacccttcagccgtggggctttgcgatcctgacccgaaactagaaaaaggccacctcgattga

SEQ ID NO: 1146 - protein, 610 aa, Corynebacterium glutamicum
MLKDLTGLRELVLREMCHSISHLSSPTGSIFTSLVAMLTSQSFSVWAPLPHDVHLILNGETLPMHKTEGSWWRAEIAPKAGDRYGFSLFDGSSWSKTLPDPRSTSQPDGVHGLSEVSDDSYLWGDQQWTGRILPGSVLYELHVGTFSEDGTFEGVVDKLPYLRDLGVTAIELLPVQPFGGNRNWGYDGVLWHAVHAGYGGPAGLKKLIDASHQAGIAVYLDVVYNHFGPDGNYNGQFGPYTSGGSTGWGDVVNINGHDSDEVRNYILDAARQWFEDFHVDGLRLDAVHSLDDRGAYSLLAQLTMVAEDVSAQTGIPRSLIAESELNDPKFVTSREAGGFGLDAQWVDDIHHALHALVSGERNGYYSDFGSVDTLAKTLREVFEHTGNYSTYRGRNHGRPVHPDITPASRFVTYTTTHDQTGNRAIGDRPSTTLTPEQQVLKAAIIYSSPYTPMLFMGEEFGATTPFAFFCSHTDPELNRLTSEGRKREFARLGWNADDIPSPELESTFTSSKLDWEFTAEQRRINDAYKQLLHLRHTLGFSQPNLLTLEVEHGENWLSMANGRGRILANFSDDTITVPLGGELIYSFTSPTVTDTSTTLQPWGFAILTRN

SEQ ID NO: 1147 - DNA, 832 bp, Corynebacterium glutamicum
  CDS (101)..(832): RXN02355
atttttgaccctccgggggtgatttaacctaaaattccacacaaacgtgttcgaggtcattagattgataagcatctgttgttaagaaaggtgacttcctatgtcctcgatttcccgcaagaccggcgcgtcacttgcagccaccacactgttggcagcgatcgcactggccggttgtagttcagactcaagctccgactccacagattccaccgctagcgaaggcgcagacagccgcggccccatcacctttgcgatgggcaaaaacgacaccgacaaagtcattccgatcatcgaccgctggaacgaagcccaccccgatgagcaggtaacgctcaacgaactcgccggtgaagccgacgcgcagcgcgaaaccctcgtgcaatccctgcaggccggcaactctgactacgacgtcatggcgctcgacgtcatctggaccgcagacttcgcggcaaaccaatggctcgcaccacttgaaggcgacctcgaggtagacacctccggactgctgcaatccaccgtggattccgcaacctacaacggcaccctctacgcactgccacagaacaccaacggccagctactgttccgcaacaccgaaatcatcccagaagcaccagcaaactgggctgacctcgtggaatcctgcacgcttgctgaagaagcaggcgttgattgcctgaccactcagctcaagcagtacgaaggcctttcagtgaacaccatcggcttcatcgaaggttggggaggcagcgtcctagacgatgacggcaaacgtcaccgtagacagcacgacggcaaggcaggccttcaagcgcttgtcgacggc

SEQ ID NO: 1148 - protein, 244 aa, Corynebacterium glutamicum
MSSISRKTGASLAATTLLAAIALAGCSSDSSSDSTDSTASEGADSRGPITFAMGKNDTDKVIPIIDRWNEAHPDEQVTLNELAGEADAQRETLVQSLQAGNSDYDVMALDVIWTADFAANQWLAPLEGDLEVDTSGLLQSTVDSATYNGTLYALPQNTNGQLLFRNTEIIPEAPANWADLVESCTLAEEAGVDCLTTQLKQYEGLSVNTIGFIEGWGGSVLDDDGKRHRRQHDGKAGLQALVDG

SEQ ID NO: 1149 - DNA, 609 bp, Corynebacterium glutamicum
  CDS (101)..(586): RXN02909
caacgcgaatgaaaacgaacagcgagcaggtctatacccacgacgtcaacgtgtgggctaatagtttcctggattgtttggcacagtcgggagaaaactcatgaaccgcgcacgaatcgcgaccataggcgttcttccgcttgctttactgctggcgtcctgtggttcagacaccgtggaaatgacagattccacctggttggtgaccaatatttacaccgatccagatgagtcgaattcgatcagtaatcttgtcatttcccagcccagcttagattttggcaattcttccctgtctggtttcactggctgtgtgccttttacggggcgtgcggaattcttccaaaatggtgagcaaagctctgttctggatgccgattatgtgaccttgtcttccctggatttcgataaacttcccgatgattgccaaggacaagaactcaaagttcataacgagctggttgatcttctgcctggttcttttgaaatctccaggacttctggttcagaaatcttgctgactagcgatgtcgatgaactcgatcggccagcaatccgcttggtgtcctggatcgcgccgacatcttaaggtgccagggctttaaagtg

SEQ ID NO: 1150 - protein, 162 aa, Corynebacterium glutamicum
MNRARIATIGVLPLALLLASCGSDTVEMTDSTWLVTNIYTDPDESNSISNLVISQPSLDFGNSSLSGFTGCVPFTGRAEFFQNGEQSSVLDADYVTLSSLDFDKLPDDCQGQELKVHNELVDLLPGSFEISRTSGSEILLTSDVDELDRPAIRLVSWIAPTS

SEQ ID NO: 1151 - DNA, 1590 bp, Corynebacterium glutamicum
  CDS (101)..(1567): RXS00349
tgtgtacatcacaatggaattcggggctagagtatctggtgaaccgtgcataaacgacctgtgattggactctttttccttgcaaaatgttttccagcggatgttgagttttgcgacccttcgtggccgcatttcaacagttgacgctgcaaaagccgcacctccgccatcgccactagccccgattgatctcactgaccatagtcaagtggccggtgtgatgaatttggctgcgagaattggcgatattttgctttcttcaggtacgtcaaatagtgacaccaaggtacaagttcgagcagtgacctctgcgtacggtttgtactacacgcacgtggatatcacgttgaatacgatcaccatcttcaccaacatcggtgtggagaggaagatgccggtcaacgtgtttcatgttgtaggcaagttggacaccaacttctccaaactgtctgaggttgaccgtttgatccgttccattcaggctggtgcgaccccgcctgaggttgccgagaaaatcctggacgagttggagcaatcccctgcgtcttatggtttccctgttgcgttgcttggctgggcaatgatgggtggtgctgttgctgtgctgttgggtggtggatggcaggtttccctaattgcttttattaccgcgttcacgatcattgccacgacgtcatttttgggaaagaagggtttgcctactttcttccaaaatgttgttggtggttttattgccacgctgcctgcatcgattgcttattctttggcgttgcaatttggtcttgagatcaaaccgagccagatcatcgcatctggaattgttgtgctgttggcaggtttgacactcgtgcaatctctgcaggacggcatcacgggcgctccggtgacagcaagtgcacgatttttcgaaacactcctgtttaccggcggcattgttgctggcgtgggtttgggcattcagctttctgaaatcttgcatgtcatgttgcctgccatggagtccgctgcagcacctaattattcgtctacattcgcccgcattatcgctggtggcgtcaccgcagcggccttcgcagtgggttgttacgcggagtggtcctcggtgattattgcggggcttactgcgctgatgggttctgcgttttattacctcttcgttgtttatttaggccccgtctctgccgctgcgattgctgcaacagcagttggtttcactggtggtttgcttgcccgtcgattcttgattccaccgttgattgtggcgattgccggcatcacaccaatgcttccaggtctagcaatttaccgcggaatgtacgccaccctgaatgatcaaacactcatgggtttcaccaacattgcggttgctttagccactgcttcatcacttgccgctggcgtggttttgggtgagtggattgcccgcaggctacgtcgtccaccacgcttcaacccataccgtgcatttaccaaggcgaatgagttctccttccaggaggaagctgagcagaatcagcgccggcagagaaaacgtccaaagactaatcagagattcggtaataaaaggtaaaaatcaacctgcttaggcgt

SEQ ID NO: 1152 - protein, 489 aa, Corynebacterium glutamicum
MLSFATLRGRISTVDAAKAAPPPSPLAPIDLTDHSQVAGVMNLAARIGDILLSSGTSNSDTKVQVRAVTSAYGLYYTHVDITLNTITIFTNIGVERKMPVNVFHVVGKLDTNFSKLSEVDRLIRSIQAGATPPEVAEKILDELEQSPASYGFPVALLGWAMMGGAVAVLLGGGWQVSLIAFITAFTIIATTSFLGKKGLPTFFQNVVGGFIATLPASIAYSLALQFGLEIKPSQIIASGIVVLLAGLTLVQSLQDGITGAPVTASARFFETLLFTGGIVAGVGLGIQLSEILHVMLPAMESAAAPNYSSTFARIIAGGVTAAAFAVGCYAEWSSVIIAGLTALMGSAFYYLFVVYLGPVSAAAIAATAVGFTGGLLARRFLIPPLIVAIAGITPMLPGLAIYRGMYATLNDQTLMGFTNIAVALATASSLAAGVVLGEWIARRLRRPPRFNPYRAFTKANEFSFQEEAEQNQRRQRKRPKTNQRFGNKR

SEQ ID NO: 1153 - DNA, 440 bp, Corynebacterium glutamicum
  CDS (1)..(417): RXS03183
gaagccgaagcaaccgcaggcaaattcgaagtacagcccctcgtaggtaaagacggcgtcggcgtatccacccttggtggctacaacaacggcatcaacgtcaactccgaaaacaaggcaaccgcccgcgacttcatcgaattcatcatcaacgaagagaaccaaacctggttcgcggacaactccttcccaccagttctggcatccatctacgatgatgagtcccttgttgagcagtacccatacctgccagcactgaaggaatccctggaaaacgcagcaccacgcccagtgtctcctttctacccagccatctccaaggcaatccaggacaacgcctacgcagcgcttaacggcaacgtcgacgttgaccaggcaaccaccgatatgaaggcagcgatcgaaaacgcttccagctagttcggtaatttagttcattc

SEQ ID NO: 1154 - protein, 139 aa, Corynebacterium glutamicum
EAEATAGKFEVQPLVGKDGVGVSTLGGYNNGINVNSENKATARDFIEFIINEENQTWFADNSFPPVLASIYDDESLVEQYPYLPALKESLENAAPRPVSPFYPAISKAIQDNAYAALNGNVDVDQATTDMKAAIENASS

SEQ ID NO: 1155 - DNA, 1212 bp, Corynebacterium glutamicum
  CDS (101)..(1189): RXC00874
agctgttccctaccattgctgaacgggagtggattgtcactttagcccctcacggattcttctggtttgatctcaccgccgatgaaaaggacgatatggaatgagcattggccaacacatcatcaccgagcgtttctacggcgccaagtcccacaccatcgacaacgtagatattgtgttgtcccgcgaatgtggcgagaacactttggctgtagtgcgcatcaacaatgcgctgtatcagttgttggtcaatgatgatggcaaagatgttctcaacgaccacgtagaagaggtcggtgcgagtttcggagcatggactggcagctctgcttttcccattggccctttcactccactcggcacagaacaatccaatagctctttcatcaccgccgacaataaagcgatcgtgaaatacttccgcaaattagaatccgggcaaaaccccgatgtggagctaatttctaaaatttcctcctgccccaacatcgcgcccatcctgggtttttcctccgctgagatctccggggctaactacaccctggtcatggcgcagcagtacgttccaggtttggatggctggtcacacgcgctgactactacctctggcagctttgcagaggatgcagaaaagatcggcgaagccacccgcaatgttcacactgctcttgcatcggccttccctactcgggtagttcccgtagaagcactcgccgatgcgctcactacccgccttaatgaactaatctcccaagcacccgaaatcgcccgcttcaaagaagcagccatcgacctctaccaatcgttggaaggcgaagcccacatccaacgcatccacggtgacctccacttggggcagctcatcaaaacccccgaacgctacatcctcatcgatttcgaaggcgaacctgcccgcccacttaatcaacgacgcctccccgactctcccctgaaagatctcgccggcatcatcagatccatcgactacgcagcctacttcgacggcgaacacacccaatgggccaacgaagccaccgcgctattcctcgacggctacggatcaattgaagaccaagaactcctcaatgcctacattctggacaaggcgttgtacgaggttgcctatgaaataaacaaccgccccgactgggtgaaaatcccactcgaggcggtcgaaaggcttctagactagttagttactctgcgtcaaac

SEQ ID NO: 1156 - protein, 363 aa, Corynebacterium glutamicum
MSIGQHIITERFYGAKSHTIDNVDIVLSRECGENTLAVVRINNALYQLLVNDDGKDVLNDHVEEVGASFGAWTGSSAFPIGPFTPLGTEQSNSSFITADNKAIVKYFRKLESGQNPDVELISKISSCPNIAPILGFSSAEISGANYTLVMAQQYVPGLDGWSHALTTTSGSFAEDAEKIGEATRNVHTALASAFPTRVVPVEALADALTTRLNELISQAPEIARFKEAAIDLYQSLEGEAHIQRIHGDLHLGQLIKTPERYILIDFEGEPARPLNQRRLPDSPLKDLAGIIRSIDYAAYFDGEHTQWANEATALFLDGYGSIEDQELLNAYILDKALYEVAYEINNRPDWVKIPLEAVERLLD

SEQ ID NO: 1157 - DNA, 18 bp, Artificial Sequence
  Description of Artificial Sequence: primer
ggaaacagtatgaccatg

SEQ ID NO: 1158 - DNA, 17 bp, Artificial Sequence
  Description of Artificial Sequence: primer
gtaaaacgacggccagt

What is claimed:

1. An isolated nucleic acid molecule comprising the nucleotide sequence of SEQ ID NO:1, or a full complement thereof.

2. An isolated nucleic acid molecule which encodes a polypeptide comprising the amino acid sequence of SEQ ID NO:2, or a full complement thereof.

3. An isolated nucleic acid molecule comprising a nucleotide sequence which is at least 95% identical to the entire nucleotide sequence of SEQ ID NO:1, wherein the nucleic acid molecule encodes a polypeptide having a diaminopimelate epimerase activity, or a full complement thereof.

4. An isolated nucleic acid molecule consisting of a fragment of at least 25 contiguous nucleotides of the nucleotide sequence of SEQ ID NO:1, or a full complement thereof.

5. An isolated nucleic acid molecule comprising a fragment of at least 25 contiguous nucleotides of the nucleotide sequence of SEQ ID NO:1, wherein the nucleic acid molecule encodes a polypeptide having a diaminopimelate epimerase activity, or a full complement thereof.

6. An isolated nucleic acid molecule which encodes a polypeptide comprising an amino acid sequence which is at least 95% identical to the entire amino acid sequence of SEQ ID NO:2, wherein the polypeptide has a diaminopimelate epimerase activity, or a full complement thereof.

7. An isolated nucleic acid molecule which hybridizes to the complement of the nucleotide sequence of SEQ ID NO:1 in 6X sodium chloride/sodium citrate (SSC) at 45° C., followed by one or more washes in 0.2 X SSC, 0.1% SDS at 50-65° C., wherein said nucleic acid molecule encodes a polypeptide with diaminopimelate epimerase activity, or a full complement thereof.

8. An isolated nucleic acid molecule comprising the nucleic acid molecule of any one of claims 1, 2, 3, 4, 5, 6, and 7 and a nucleotide sequence encoding a heterologous polypeptide.

9. A vector comprising the nucleic acid molecule of any one of claims 1, 2, 3, 4, 5, 6, and 7.

10. The vector of claim 9, which is an expression vector.

11. A host cell transfected with the expression vector of claim 10.

12. The host cell of claim 11, wherein said cell is a microorganism.

13. The host cell of claim 12, wherein said cell belongs to the genus *Corynebacterium* or *Brevibacterium*.

14. A method of producing a polypeptide comprising culturing the host cell of claim 11 in an appropriate culture medium to, thereby, produce the polypeptide.

15. A method for producing an amino acid, comprising culturing the cell of claim 11 such that the amino acid is produced, wherein said cell is a bacterial cell.

16. The method of claim 15, wherein said method further comprises the step of recovering the amino acid from said culture.

17. The method of claim 15, wherein said cell belongs to the genus *Corynebacterium* or *Brevibacterium*.

18. The method of claim 15, wherein said cell is selected from the group consisting of: *Corynebacterium glutamicum, Corynebacterium herculis, Corynebacterium lilium, Corynebacterium acetoacidophilum, Corynebacterium acetoglutamicum, Corynebacterium acetophilum, Corynebacterium ammoniagenes, Corynebacterium fujiokense, Corynebacterium nitrilophilus, Brevibacterium ammoniagenes, Brevibacterium butanicum, Brevibacterium divaricatum, Brevibacterium flavum, Brevibacterium healii, Brevibacterium ketoglutamicum, Brevibacterium ketosoreductum, Brevibacterium lactofermentum, Brevibacterium linens, Brevibacterium paraffinolyticum*, and those strains set forth in Table 3.

19. The method of claim 15, wherein expression of the nucleic acid molecule from said vector results in modulation of production of said amino acid.

20. The method of claim 15, wherein said amino acid is a proteinogenic or nonproteinogenic amino acid.

21. The method of claim 15, wherein said amino acid is a proteinogenic amino acid.

22. The method of claim 15, wherein said amino acid is selected from the group consisting of: lysine, glutamate, glutamine, alanine, aspartate, glycine, serine, threonine, methionine, cysteine, valine, leucine, isoleucine, arginine, proline, histidine, tyrosine, phenylalanine, and tryptophan.

23. A method for producing an amino acid, comprising culturing a bacterial cell whose genomic DNA has been altered by the inclusion of a nucleic acid molecule of any one of claims 1, 2, 3, 4, 5, 6, and 7.

24. A method for diagnosing the presence or activity of *Corynebacterium diphtheriae* in a subject, comprising detecting the presence or activity of the nucleic acid molecule of any one of claims 1, 2, 3, 4, 5, 6, and 7, thereby diagnosing the presence or activity of *Corynebacterium diphtheriae* in the subject.

* * * * *